United States Patent
Ayalon-Soffer et al.

(10) Patent No.: US 7,939,634 B2
(45) Date of Patent: May 10, 2011

(54) POLYNUCLEOTIDES ENCODING POLYPEPTIDES AND METHODS USING SAME

(75) Inventors: Michal Ayalon-Soffer, Ramat-HaSharon (IL); Zurit Levine, Herzlia (IL); Osnat Sella-Tavor, Kfar-Kish (IL); Alex Diber, Rishon-LeZion (IL); Ronen Shemesh, ModiIn (IL); Amir Toporik, Azur (IL); Galit Rotman, Herzlia (IL); Sergey Nemzer, RaAnana (IL); Avi Rosenberg, Kfar Saba (IL); Dvir Dahary, Tel-Aviv (IL); Assaf Wool, Kiryat-Ono (IL); Gad S. Cojocaru, Ramat-HaSharon (IL); Pinchas Akiva, Ramat-Gan (IL); Sarah Pollock, Tel-Aviv (IL); Kinneret Savitsky, Tel Aviv (IL); Jeanne Bernstein, Kfar Yona (IL)

(73) Assignee: Compugen Ltd., Tel Aviv (IL)

( * ) Notice: Subject to any disclaimer, the term of this patent is extended or adjusted under 35 U.S.C. 154(b) by 1254 days.

(21) Appl. No.: 11/043,770

(22) Filed: Jan. 27, 2005

(65) Prior Publication Data
US 2010/0075891 A1    Mar. 25, 2010

Related U.S. Application Data

(60) Provisional application No. 60/607,246, filed on Sep. 7, 2004, provisional application No. 60/587,851, filed on Jul. 15, 2004, provisional application No. 60/539,127, filed on Jan. 27, 2004.

(51) Int. Cl.
*C12P 21/08* (2006.01)
*C07K 16/28* (2006.01)
*G01N 33/53* (2006.01)

(52) U.S. Cl. ............. 530/387.1; 530/388.1; 530/388.15; 530/388.24; 435/7.1; 435/7.92; 435/7.94; 435/810

(58) Field of Classification Search .................. None
See application file for complete search history.

(56) References Cited

U.S. PATENT DOCUMENTS

| | | | |
|---|---|---|---|
| 5,545,537 A | 8/1996 | Skelly et al. | |
| 5,641,657 A | 6/1997 | Ruben et al. | |
| 6,180,355 B1 | 1/2001 | Alexander et al. | |
| 6,270,993 B1 * | 8/2001 | Shibuya et al. | 435/69.1 |
| 6,342,219 B1 * | 1/2002 | Thorpe et al. | 424/145.1 |

FOREIGN PATENT DOCUMENTS

| | | |
|---|---|---|
| WO | WO 03/033514 | 4/2003 |
| WO | WO 03/040330 | 5/2003 |
| WO | WO 2005/072340 | 8/2005 |
| WO | WO 2006/043271 | 4/2006 |
| WO | WO 2006/054297 | 5/2006 |
| WO | WO 2006/072954 | 7/2006 |

OTHER PUBLICATIONS

Riemer et al, Mol. Immunol. 42: 1121-1124, 2005.*
Chandra et al. "Sequence Homology Between Human Alpha 1-Antichymotrypsin, Alpha 1 Antitrypsin, and Antithrombin III", Biochemistry, 22(22): 5055-5061, 1983. Database Genbank 'Online!, Database Accession No. P01011.
Kanikowska et al. "Microheterogeneity of Two Acute Phase Proteins in Patients With Advanced Ovarian Carcinoma: A Preliminary Study", Central-European Journal of Immunology, 23(3-4): 237-242, 1998.
Kuryliszyn-Moskal et al. "Alpha1-Antitrypsin and Alpha1-Antichymotrypsin Serum Level in Relation to Staging and Postoperative Clinical Course of Human Colorectal Cancer", Advances in Experimental Medicine and Biology, 240: 561-564, 1988.
Lai et al. "Alpha-1-Antichymotrypsin Immunoreactivity in Papillary Carcinoma of the Thyroid Gland", Histopathology, 33(4): 332-336, 1998.
Zelvyte et al. "Increased Plasma Levels of Serine Proteinase Inhibitors in Lung Cancer Patients", Anticancer Research, 24: 241-248, 2004.

* cited by examiner

*Primary Examiner* — Phuong Huynh
(74) *Attorney, Agent, or Firm* — Fennemore Craig, P.C.

(57) ABSTRACT

Novel polypeptides and polynucleotides encoding same are provided. Also provided methods and pharmaceutical compositions which can be used to treat various disorders such as cancer, immunological-related, blood-related and skin-related disorders using the polypeptides and polynucleotides of the present invention. Also provided are methods and kits for diagnosing, determining predisposition and/or prognosis of various disorders using as diagnostic markers the novel polypeptides and polynucleotides of the present invention.

5 Claims, 298 Drawing Sheets

Figure 1a

```
>HUMGCSF_T3
AGTCGTGGCCCCAGGTAATTTCCTCCCAGGCCTCCATGGGGTTATGTATAAAGGCCCCC
tagagctgggccccaaaacagcccggagcctgcagcccagccccacccagacccatggct
ggacctgccacccagagccccatgaagctgatgggtgagtgtcttggcccaggatgggag
agccgctgccctggcatggagggaggctggtgtgacagagggctggggatcccgtt
ctgggaatggggattaaaggcacccagtgtccccgagagggcctcaggtggtagggaaca
gcatgtctcctgagcccgctctgtccccagcctgcagctgctgctgtggcacagtgcac
tctggacagtgcaggaagccaccccctgggccctgccagctccctgcccagagcttcc
tgctcaagtgcttagagcaagtgaggaagatccagggcgatggcgcagcgctccaggaga
agctgtgtgccacctacaagctgtgccaccccgaggagctggtgctgctcggacactctc
tgggcatccctgggctccctgagcagctgcccagccaggccctgcagctggtgagtg
tcaggaaaggataaggctaatgaggagggggaaggagaggaggaacacccatgggctccc
ccatgtctccaggttccaagctgggggcctgacgtatctcaggcagcacccctaactct
tccgctctgtctcacaggcaggctgcttgagccaactccatagcggccttttcctctacc
agggctcctgcaggccctggaagggatctccccgagttgggtcccaccttggacacac
tgcagctggacgtcgccgactttgccaccaccatctggcagcagatggaagaactgggaa
tggccctgccctgcagccacccagggtgccatgccggccttcgcctctgctttccagc
gccgggcaggagggtcctggttgcctcccatctgcagagcttcctggaggtgtcgtacc
gcgttctacgccaccttgcccagccctgagccaagccctccccatcccatgtatttatct
ctatttaatatttatgtctatttaagcctcatatttaaagacagggaagagcagaacgga
gccccaggcctctgtgtccttccctgcatttctgagtttcattctcctgcctgtagcagt
gagaaaaagctcctgtcctccatccctggactggaggtagataggtaaataccaagt
atttattactatgactgctccccagccctggctctgcaatgggcactgggatgagccgct
gtgagcccctggtcctgagggtccccacctgggaccttgagagtatcaggtctcccacg
tgggagacaagaaatccctgtttaatatttaaacagcagtgttcccatctgggtccttg
cacccctcactctggcctcagccgactgcacagcggccctgcatcccttggctgtgag
gcccctggacaagcagaggtggccagagctgggaggcatggccctggggtcccacgaatt
tgctggggaatctcgttttcttcttaagacttgggacatggtttgactcccgaacat
caccgacgtgtctcctgtttttctgggtggcctcgggacacctgcctgccccacgagg
gtcaggactgtgactcttttagggccaggcaggtgcctggacatttgccttgctggacg
gggactggggatgtgggagggagcagacaggaggaatcatgtcaggcctgtgtgtgaaag
gaagctccactgtcaccctccacctcttcaccccccactcaccagtgtcccctccactgt
cacattgtaactgaacttcaggataataaagtgtttgcctccaaaaacgtcc
```

Figure 1b

```
>HUMGCSF_P4
MSPEPALSPALQLLLWHSALWTVQEATPLGPASSLPQSFLLKCLEQVRKIQGDGAALQEK
LCATYKLCHPEELVLLGHSLGIPWAPLSSCPSQALQL*VSVRKG*
```

Alignment of: HSFLT_PEA_1_P4 (SEQ ID NO:532) x VGR1_HUMAN (SEQ ID NO:530)

```
  1 MVSYWDTGVLLCALLSCLLLTGSSSGSKLKDPELSLKGTQHIMQAGQTLH  50
    ||||||||||||||||||||||||||||||||||||||||||||||||||
  1 MVSYWDTGVLLCALLSCLLLTGSSSGSKLKDPELSLKGTQHIMQAGQTLH  50

51 LQCRGEAAHKWSLPEMVSKESERLSITKSACGRNGKQFCSTLTLNTAQAN 100
    ||||||||||||||||||||||||||||||||||||||||||||||||||
 51 LQCRGEAAHKWSLPEMVSKESERLSITKSACGRNGKQFCSTLTLNTAQAN 100

101 HTGFYSCKYLAVPTSKKKETESAIYIFISDTGRPFVEMYSEIPEIIHMTE 150
    ||||||||||||||||||||||||||||||||||||||||||||||||||
101 HTGFYSCKYLAVPTSKKKETESAIYIFISDTGRPFVEMYSEIPEIIHMTE 150

151 GRELVIPCRVTSPNITVTLKKFPLDTLIPDGKRIIWDSRKGFIISNATYK 200
    ||||||||||||||||||||||||||||||||||||||||||||||||||
151 GRELVIPCRVTSPNITVTLKKFPLDTLIPDGKRIIWDSRKGFIISNATYK 200

201 EIGLLTCEATVNGHLYKTNYLTHRQTNTIIDVQISTPRPVKLLRGHTLVL 250
    ||||||||||||||||||||||||||||||||||||||||||||||||||
201 EIGLLTCEATVNGHLYKTNYLTHRQTNTIIDVQISTPRPVKLLRGHTLVL 250

251 NCTATTPLNTRVQMTWSYPDEKNKRASVRRRIDQSNSHANIFYSVLTIDK 300
    ||||||||||||||||||||||||||||||||||||||||||||||||||
251 NCTATTPLNTRVQMTWSYPDEKNKRASVRRRIDQSNSHANIFYSVLTIDK 300

301 MQNKDKGLYTCRVRSGPSFKSVNTSVHIYDKAFITVKHRKQQVLETVAGK 350
    ||||||||||||||||||||||||||||||||||||||||||||||||||
301 MQNKDKGLYTCRVRSGPSFKSVNTSVHIYDKAFITVKHRKQQVLETVAGK 350

351 RSYRLSMKVKAFPSPEVVWLKDGLPATEKSARYLTRGYSLIIKDVTEEDA 400
    ||||||||||||||||||||||||||||||||||||||||||||||||||
351 RSYRLSMKVKAFPSPEVVWLKDGLPATEKSARYLTRGYSLIIKDVTEEDA 400

401 GNYTILLSIKQSNVFKNLTATLIVNVKPQIYEKAVSSFPDPALYPLGSRQ 450
    ||||||||||||||||||||||||||||||||||||||||||||||||||
401 GNYTILLSIKQSNVFKNLTATLIVNVKPQIYEKAVSSFPDPALYPLGSRQ 450

451 ILTCTAYGIPQPTIKWFWHPCNHNHSEARCDFCSNNEESFILDADSNMGN 500
    ||||||||||||||||||||||||||||||||||||||||||||||||||
451 ILTCTAYGIPQPTIKWFWHPCNHNHSEARCDFCSNNEESFILDADSNMGN 500

501 RIESITQRMAIIEGKNKL                                 518
    |||||||||||||||||:
501 RIESITQRMAIIEGKNKM                                 518
```

GCSF structure

W.T  [SP]—[ IL6/GCSF/MGF family ]
     1-30         51-202

T3   [SP]-[IL6/GCSF/fam.]
     7-30   47-97   6 a.a

Figure 5a

>HUMTNFRRP_T19
GATTGCGACAGGCCGGCCTGGCTCCCAGCGCTCCCTGTCCCGCCCCGCGGCCAGCTCGC
tccactcccacttcctgagctccgccgtgggagccctggaggcccggcctggccgctccc
ggccctggggtgcacatcggccctgagtcccgtcccaggctctggctggggcagccgcc
gccaccgctgcccaggacgtgggcctcctgccttcctccaggcccccacgttgctggc
cgcctggccgagtggccgccatgctcctgccttgggccacctctgccccggcctggct
ggggcctctggtgctgggcctcttcggcctctggcagcatcgcagccccaggcggtgc
ctccatatgcgtcggagaaccagacctgcagggaccaggaaaaggaatactatgagccc
agcaccgcatctgctgctcccgctgcccgccaggcacctatgtctcagctaaatgtagcc
gatccgggacacagtttgtgccacatgtgccgagaattcctacaacgagcactggaact
acctgaccatctgccagctgtgccgcccctgtgacccagtgatgggcctcgaggagattg
cccctgcacaagcaaacggaagacccagtgccgctgccagccgggaatgttctgtgctg
cctggggcctcgagtgtacacactgcgagctactttctgactgcccgcctggcactgaag
ccgagctcaaa*ggtcagaggtccctgaggggctgga tgtgaaaggaggctgggtgccag
ggatctcaagtgggagcagggaatatgg*

Figure 5b

>HUMTNFRRP_P14
MLLPWATSAPGLAWGPLVLGLFGLLAASQPQAVPPYASENQTCRDQEKEYYEPQHRICCS
RCPPGTYVSAKCSRIRDTVCATCAENSYNEHWNYLTICQLCRPCDPVMGLEEIAPCTSKR
KTQCRCQPGMFCAAWALECTHCELLSDCPFGTEAELK*GQRSLRGWM*

Figure 7

Alignment of HUMTNFRRP_P14 (SEQ ID NO: 5) to TNR3_HUMAN (SEQ ID NO:129)

```
  1 MLLPWATSAPGLAWGPLVLGLFGLLAASQPQAVPPYASENQTCRDQEKEY  50
    ||||||||||||||||||||||||||||||||||||||||||||||||||
  1 MLLPWATSAPGLAWGPLVLGLFGLLAASQPQAVPPYASENQTCRDQEKEY  50

51 YEPQHRICCSRCPPGTYVSAKCSRIRDTVCATCAENSYNEHWNYLTICQL 100
    ||||||||||||||||||||||||||||||||||||||||||||||||||
 51 YEPQHRICCSRCPPGTYVSAKCSRIRDTVCATCAENSYNEHWNYLTICQL 100

101 CRPCDPVMGLEEIAPCTSKRKTQCRCQPGMFCAAWALECTHCELLSDCPP 150
    ||||||||||||||||||||||||||||||||||||||||||||||||||
101 CRPCDPVMGLEEIAPCTSKRKTQCRCQPGMFCAAWALECTHCELLSDCPP 150

151 GTEAELKGQRSLRGWM                                   166
    |||||||
151 GTEAELK.........                                   157
```

Figure 8

TNFR 3- structure

W.T  | SP | TNFR Cys-rich | TNFR Cys-rich | TNFR Cys-rich | TNFR Cys-rich | ▓▓ | cytoplasmic |
1-30  42-80  83-124  126-156  170-210  228-248  249-435

T19  | SP | TNFR Cys-rich | TNFR Cys-rich | TNFR Cys-rich |▓
1-30  42-80  83-124  126-156  9 a.a

Figure 9a

>HSIL4R_T5

```
TGCAGTGCCCGACAGATTGTACTAGTTACTGATTGAAGGGCTGTTTTACTATCCAAATGTGGCTGGAGTAGGAGTTGGGT
AAACATTTATTGAAGAATGTGCAACCACTCTCACTTGGAAGCCGGGCTGTTAGGAAGGGGAGGAGGATTCCAGTCGCCCA
GCCCTCCCCCACCAAACGCAACTGCCCCGGCGCAAAAGAGGCCGGCGAGGCCAGGCAGGAGCAGGTCCTGGAGGCCTGGT
CGGCGTGGGCGTTTTATTCCGAGACCAAGGGGATCCACTGCAGAGTTCTCCGCTGGGCGTGACCTCGGGCTACGGCGTGG
GAGGAAGCCGCGCGGCAAGACACCCAGCGAGGTGCTCGGGGTGCCCCAGGAGAGGACGGCGGCTCGGACTGTCCGGCGGC
GGCGGCGGGGACAGCGACAGGGCGCGAGGTGGCCGGGACCCGGGCCGGCCGCCGGGCGGGGCGGCGCATGCAAATCT
GCCGGCGCCGGGCGGGGAGCAGGAAGCCGGGCGGGCTGGGTCTCCGCGCCCAGGAAAGCCCGGCCGGGCGCGGGCCA
GGGAAGGGCCACCCAGGGGTCCCCCACTTCCCGCTTGGGCGCCCGGACGGCGAATGGAGCAGGGGCGCGCAGATAATTAA
AGATTTACACACAGCTGGAAGAAATCATAGAGAAGCCGGGCGTGGTGGCTCATGCCTATAATCCCAGCACTTTTGGAGGC
TGAGGCGGGCAGATCACTTGAGATCAGGAGTTCGAGACCAGCCTGGTGCCTTGGCATCTCCCCAATGGGGTGGCTTTGCTC
TGGGCTCCTGTTCCCTGTGAGCTGCCTGGTCCTGCTGCAGGTGGCAAGCTCTGGGAACATGAAGGTCTTGCAGGAGCCCA
GCTGCGTCTCCGACTACATGAGCATCTCTACTTGCCAGTGGAAGATGAATGGTCCCACCAATTGCAGCACCGAGCTCCGC
CTGTTGTACCAGCTCGTTTTTCTGCTCTCCGAAGCCCACACGTGTATCCCTGAGAACAACGGAGGCGCGGGGTGCCGTGTG
CCACCTGCTCATCGATGACGTGGTCAGTGCGGATAACTATACACTGGACCTGTGGGCTGGCCAGCAGCTGCTCTGGAAGG
GCTCCTTCAAGCCCAGCGAGCATGTGCCCGGAAGGCCGTATTGACATGAGGTGTGCTTGCTGGAAGGCATGCCTGCTGCT
GATTGAAAACCGAACTGGGAACAGTCCTTCCATTCTGTGTCCACTGGTCAGCTGCTGCGGCTTTGATGGTCTTGACCGT
GGAAGGCTGACCTTCTTCTGGTACCCGGAGTCCCTGCAGGAATCCCCCTTGACTTGCTGGGCTGTGGTACAGAGTTT
AAAACATGCCGTTGTATTCCAGTGATGCATGATATGACATGCATCACAGGAATAAAAACCTGAGGTCTCATGGATATGATT
GCTTCAAACTGCCTAAGTTTTAAAGAGATGAATAAAACATTACTCAGTGAATCATCATAAGTACAGAGA
TGTGCCAAAGGTGTGAAGGATGCAGCTGTAAAGCTGAAGTTTGAGGCCCAGTGTGGTGGTTATGCCTATAATCCCAG
CACTTTGGGAGGCCGAGGCCAGCGGATCACCGGAGGTCAGGAGTTCGAGACCAGCCTGGACAACATGTGAAACCCAGGGC
CCCAGCAAAGCCTGACAGTTCACACCAATGTCTCCGACACTCTCCTGCTGACCTGGAGCAACCCGTATCCCCCTGACAATT
ACCTGTATAATCATCTCACCTATCCAGTCAACATTTGGAGTGAAAACGACCCGGCAGATTTCAGAATCTATAACGTGACC
TACCTAGAACCCTCCCTCCGCATCGCAGCCAGCACCCTGAAGTCTGGGATTTCCTACAGGGCACGGGTGAGGGCCTGGGC
TCAGTGCTATAACACCACCTGGAGTGAGTGGAGCCCCAGCACCCAAGTGGCACAACTCCTACAGGGAGCCCTTCGAGCAGC
ACCTCCTGCTGGGCGTCAGCGTTTCCTGCATTGTCATCCTGGCCGTCTGCCTGTTGTGCTATGTCAGCATCACCAAGATT
AAGAAAGAATGGTGGGATCAGATTCCCAACCCAGCCCGCAGCCGCCTCGTGGCTATAATAATCCAGGATGCTCAGGGGTC
ACAGTGGGAGAAGCCGTCCCGACGCCAGGAACCAGCCAAGTGCCCACACTGGAAGAATTGTCTTACCAAGCTCTTGCCCT
GTTTTCTGGCACAACATGAAAAGGGATGAAGATCCTCACAAGGCTGCCAAAGAGATGCCTTTCCAGGGCTCTGGAAAA
TCAGCATGGTGCCCCAGTGGAGATCAGCAGACAGTCCTCTGGCCAGCAGCGTCAGCGTGGTGCGATGTGTGGCAGTTGTT
TGAGGCCCCGGTGGAGTGTGAGGCGAGGAGGAGGTAGAGCAAGAAAAAGAGCTTCTGTGCATCGCCTCAGAGCAGCA
GGGATGACTTCCAGGAGGGAAGGGAGGGCATTGTGGCCCGGCTAACAGAGATGCCTGTTCCTGGACCTGCTCGGAGAGGAG
AATGGCGGCTTTTGCCAGCAGGACATGGGGAGTCATGCCTTCTTCCACCTTCGGGAAGTACGAGTGCTCACATGCCCTG
GGATGAGTTCCCAAGTGCAGGGCCAAGGAGCACCTCCCTGGGCAAGGAGCAGCCTCTCCACCTGGAGCCAAGTCCTC
CTGCCAGCCCGACCCAGAGTCCAGACAACCTGACTTGCACAGAGACGCCCCTCGTCATCGCAGGCAACCCTGCTTACCGC
AGCTTCAGCAACTCCTTGAGCCAGTCACCGTGTCCCAGAGAGCTGGGTCCAGACCCACTGCTGGCCAGACACCTGGAGGA
AGTAGAACCGAGATGCCCTGTGTCCCCAGCTCTCTGAGCCAACTACTGTGCCCCAACCTGAGCCAGAAACCTGGCAGC
AGAATCCTCCCGCCGAAATGTCCTCCAGCATGGGGCAGCTGCAGCCCCGTCTCGGCCCCCACCAGTGGCTATCAGGAGTTT
GTACATGCGGTGGAGCAGGGTGGCACCCAGGCGCGTGCGGTGCGCCTTGGGTCCCCGAGGAGGAGCTGGTTACAAGGC
CTTCTCAAGCCTGCTTGCCAGCAGTGCTGTGTCCCAGAGAAATGTGGCTTTGGGGCTAGCAGTGGGGAAGAGGGGTATA
AGCCTTTCCAAGACCTCATTCCTGGCTGCCCTGGGGACCCTGCCCCAGTCCCTGTCCCCTTGTTCACCTTTGGACTGGAC
AGGGAGCCACCTCGCAGTCCCGAGAGCTCACATCTCCCAAGCAGCTCCCCAGAGCACCTGGGTCTGGAGCCGGCGCAAAA
GGTAGAGGACATGCCAAAGCCCCCACTTCCCCAGGAGCAGGCCACAGACCCCCTTGTGGACAGCCTGGGCAGTGGCATTG
TCTACTCAGCCCCTTACCTGCCCACCTGTCCGCCCACCTGAAACAGTGTCATGGCCAGGAGGATGGTGGCCAGACCCCTGT
CATGGCCAGTCCTTGCTGTGGCTGCTGCTGTGGAGACAGGTCCTGGCCCCCTACAACCCCCTGAGGGCCCCAGACCCCT
CTCCAGGTGGGGTTCCACTGGAGGCCAGTCTGTGTCCGGCCTCCCTGGCACCCTCGGGCATCTCAGAGAAGAGTAAATCC
TCATCATCCTTCCATCCTGCCCCTGGCAATGCTCAGAGCTCAAGCCAGACCCCAAAATCGTGAACTTTGTCTCCGTGGG
ACCCACATACATGAGGGTCTCTTAGGTGCATGTCCTCTTGTTGCTGAGTCTGCAGATGAGGACTAGGGCTTATCCATGCC
TGGGAAATGCCACCTCCTGGAAGGCAGCCAGGCTGGCAGACTGGACCCCGCCCAGCATTGGGCTGGGCTCGCCACATCCCATG
AGAGTAGAGGGCACTGGGTCGCCGTGCCCCACGGCAGCCCCTGCAGGAAAACTGAGGCCCTTGGGCACCTCGACTTGTG
AACGAGTTGTTGGCTGCTCCCCTCCACAGCTTCTGCAGCAGACTGTCCCTGTTGTAACTGCCCAAGGCATGTTTTGCCCAC
CGGATCATGGCCCACATGGAGGCCCACCTGCCTCTGTCTCACTGAACTAGAAGCCGAGCCTAGAAACTAACACAGCCATC
AAGGGAATGACTTGGGCGGCCTTGGGAAATCGATGAGAAATTGAACTTCAGGGAGGGTGGTCATTGCCTAGAGGTGCTCA
TTCATTTAACAGAGCTTCCTTAGGTTGATGCTGGAGGCAGAATCCCGGCTGTCAAGGGGTGTTCAGTTAAGGGGAGCAAC
AGAGGACATGAAAATTGCTGTGACTAAAGCAGGGACAATTTGCTGCCAAACACCCATGCCCAGCTGTATGGCTGGGGGC
TCCTCGTATGCATGCAACCCCAGAATAAATATGCTCAGCCACCCTGTGGGCCGGGCAATCCAGACAGCAGGCATAAGGC
ACCAGTTACCCTGCATGTTGGCCCACATCCAGTGCTAGGGAAGGCGGGAACCTTGGGTTGASTAATGCTCGTCTGTGT
GTTTTAGTTTCATCACCTGTTATCTGTGTTGCTGAGGAGAGTGGAACAGAAGGGGTGGAGTTTTGTATAAATAAAGTTT
CTTTGTCTCTTAAAAATTATGTATTAACCAAACATACCTCCAGAC
```

Figure 9b

>HSIL4R_T5 (SEQ ID NO:9)

MGWLCSGLLFPVSCLVLLQVASSGNMKVLQEPTCVSDYMSISTCEWKMNGPTNCSTELR
LLYQLVFLLSEAHTCIPENNGGAGCVCHLLMDDVVSADNYTLDLWAGQQLLWKGSFKPS
EHVPRKAY

Figure 10

Alignment of CDS-2_HSIL4R_T5 (SEQ ID NO: 9) to IL4R_HUMAN (SEQ ID NO:130)

```
  1 MGWLCSGLLFPVSCLVLLQVASSGNMKVLQEPTCVSDYMSISTCEWKMNG  50
    ||||||||||||||||||||||||||||||||||||||||||||||||||
  1 MGWLCSGLLFPVSCLVLLQVASSGNMKVLQEPTCVSDYMSISTCEWKMNG  50

51 PTNCSTELRLLYQLVFLLSEAHTCIPENNGGAGCVCHLLMDDVVSADNYT 100
    ||||||||||||||||||||||||||||||||||||||||||||||||||
 51 PTNCSTELRLLYQLVFLLSEAHTCIPENNGGAGCVCHLLMDDVVSADNYT 100

101 LDLWAGQQLLWKGSFKPSEHVPRKAY                         126
    ||||||||||||||||||||||
101 LDLWAGQQLLWKGSFKPSEHV.....                         121
```

Figure 12a

```
>HUMVTNR_P5
GATAAAAAGCTTTCCTCATTTTTAAACAACAGTCGCACGGAAGTTCCCGGCGGGACAAGG
GAACGTGGGTGCCCTTGCTACTCCCGTGGACGCGGGTAGATTGGGACGCTGGACCGTATC
TCCCCGCCCCCGCCCCACGCCTCCTCAGGTGCTCAGCCTGAGGCCTTCGTCCAGGAGCG
CTGCCGCTGACCCAGGCTCAGGAGCTGGGGGCCCCTGCACAGACGCCCAGGTCTCGGGAC
AGGCGGCGACTGCACTCACGGAAGTACGCTGAGCTCTCCCCTGTAGAAGGGCGCCTCTCC
TCCCCCACTTCCTCCTCCAGCTCCACAGCAGCCTCCCGGGCCGGCTCCTCCTCCTTCCAG
GTCTCCTCCCAGTGCCGCCGCGGCTCTCAGGCCTGAGGTGCGGCGCTCACCCCGGCAGTC
CCCAGCCTCAGACGCTGCGTGGAGCGGCGAGCCGGAGGGAAGCAAAGGACCGTCTGCGC
TGCTGTCCCGCCCCGCGCCTCTGCCCCCTCGTCCCTGGCGGTCGCTCCGAAGCTCAG
CCCTCTTGCCTGCCCCGGAGCTGTCCCGGGCTAGCCGAGAAGAGAGCGGCCGGCAAGTTT
GGGCGCGCGCAGGCGGCGGGCCGCGGGCACTGGGCGCCTCGCTGGGGCGGGGGGAGGTGG
CTACCGGCTCCCGGCTTGGCGTCCCGCGCGCACTTCGGCGATGGCTTTTCCGCCGCGGCGA
CGGCTGCGCCTCGGTCCCCGCGGCCTCCCGCTTCTTCTCTCGGGACTCCTGCTACCTCTG
TGCCGCGCCTTCAACCTAGACGTGGACAGTCCTGCCGAGTACTCTGGCCCCGAGGGAAGT
TACTTCGGCTTCGCCGTGGATTTCTTCGTGCCCAGCGCGTCTTCCCGGATGTTCTTCTC
GTGGGAGCTCCCAAAGCAAACACCACCCAGCCTGGGATTGTGGAAGGAGGGCAGGTCCTC
AAATGTGACTGGTCTTCTACCCGCCGGTGCCAGCCAATTGAATTTGATGCAACAGGCAAT
AGAGATTATGCCAAGGATGATCCATTGGAATTTAAGTCCCATCAGTGGTTTGGAGCATCT
GTGAGGTCGAAACAGGATAAAATTTTGGCCTGTGCCCCATTGTACCATTGGAGAACTGAG
ATGAAACAGGAGCGAGAGCCTGTTGGAACATGCTTTCTTCAAGATGGAACAAAGACTGTT
GAGTATGCTCCATGTAGATCACAAGATATTGATGCTGATGGACAGGGATTTTGTCAAGGA
GGATTCAGCATTGATTTTACTAAAGCTGACAGAGTACTTCTTGGTGGTCCTGGTAGCTTT
TATTGGCAAGGTCAGCTTATTTCGGATCAAGTGGCAGAAATCGTATCTAAATACGACCCC
AATGTTTACAGCATCAAGTATAATAACCAATTAGCAACTCGGACTGCACAAGCTATTTTT
GATGACAGCTATTTGGGTGAAACACTGAGGCACTGAGACGCAAAATAACTTGCCCAAAG
TCACTCGCTTGTAACTTGCTGTTCAGAGATTCAAATGGAGACAGTCTAACTCCTGAAGTT
TTCTTCATGATGTTAAATAAAAGTTTTGGTCTTTAGGACTTA
```

Figure 12b

```
>HUMVTNR_P5 # Length: 298 #SW ITAV_HUMAN

MAFPPRRRLRLGPRGLPLLLSGLLLPLCRAFNLDVDSPAEYSGPEGSYFGFAVDFFVPSA
SSRMFLLVGAPKANTTQPGIVEGGQVLKCDWSSTRRCQPIEFDATGNRDYAKDDPLEFKS
HQWFGASVRSKQDKILACAPLYHWRTEMKQEREPVGTCFLQDGTKTVEYAPCRSQDIDAD
GQGFCQGGFSIDFTKADRVLLGGPGSFYWQGQLISDQVAEIVSKYDPNVYSIKYNNQLAT
RTAQAIFDDSYLGENTEALRRKITCPKSLACNLLFRDSNGDSLTPEVFTNMLNKSFGL
```

Figure 14

Alignment of HUMVTNR_P5 (SEQ ID NO: 13) to ITAV_HUMAN (SEQ ID NO:131)

```
  1 MAFPPRRRLRLGPRGLPLLLSGLLLPLCRAFNLDVDSPAEYSGPEGSYFG  50
    ||||||||||||||||||||||||||||||||||||||||||||||||||
  1 MAFPPRRRLRLGPRGLPLLLSGLLLPLCRAFNLDVDSPAEYSGPEGSYFG  50

51 FAVDFFVPSASSRMFLLVGAPKANTTQPGIVEGGQVLKCDWSSTRRCQPI 100
    ||||||||||||||||||||||||||||||||||||||||||||||||||
 51 FAVDFFVPSASSRMFLLVGAPKANTTQPGIVEGGQVLKCDWSSTRRCQPI 100

101 EFDATGNRDYAKDDPLEFKSHQWFGASVRSKQDKILACAPLYHWRTEMKQ 150
    ||||||||||||||||||||||||||||||||||||||||||||||||||
101 EFDATGNRDYAKDDPLEFKSHQWFGASVRSKQDKILACAPLYHWRTEMKQ 150

151 EREPVGTCFLQDGTKTVEYAPCRSQDIDADGQGFCQGGFSIDFTKADRVL 200
    ||||||||||||||||||||||||||||||||||||||||||||||||||
151 EREPVGTCFLQDGTKTVEYAPCRSQDIDADGQGFCQGGFSIDFTKADRVL 200

201 LGGPGSFYWQGQLISDQVAEIVSKYDPNVYSIKYNNQLATRTAQAIFDDS 250
    ||||||||||||||||||||||||||||||||||||||||||||||||||
201 LGGPGSFYWQGQLISDQVAEIVSKYDPNVYSIKYNNQLATRTAQAIFDDS 250

251 YLGENTEALRRKITCPKSLACNLLFRDSNGDSLTPEVFFMMLNKSFGL    298
    |||
251 YLG..............................................  253
```

Figure 15

ITAV structure

W.T  SP | Int α | Int α | Int α | Int α —————— Int-α
     1-30 46-  249- 303- 367- 432-         992-  1017-
          108  302  362  427  483          1016  1031

TS   SP | Int α
     1-30 46-
          108
                    45 a.a

Figure 16a

```
>T07758_T12
agaagaggcggcgcgtgcgtagagggcggtgagagctaagaggggcagcgcgtgtgcag
agggggcggtgtgacttaggacggggcgatggcggctgagaggagctgcgcgtgcgcgaac
atgtaactggtgggatctgcggcggctcccagatgatggtcgtcctcctgggcgcgacga
cctagtgctcgtcgccgtggcgccatgggtgttgtccgcagccgcaggtgaaaaaatc
taaaatctcctcaaaagtagaggtcgacatcatagatgacaactttatcctgaggtgga
acaggagcgatgagtctgtcgggaatgtgacttttcattcgattatcaaaaaactggga
tggataattggataaaattgtctgggtgtcagaatattactagtaccaaatgcaacttt
cttcactcaagctgaatgtttatgaagaaattaaattgcgtataagagcagaaaaagaaa
acacttcttcatggtatgaggttgactcatttacaccatttcgcaaagctcagattggtc
ctccagaagtacatttagaagctgaagataaggcaatagtgatacacatctctcctggaa
caaaagatagtgttatgtgggctttggatggtttaagctttacatatagcttagttatct
ggaaaaactcttcaggtgtagaagaaaggattgaaaatatttattccagacataaaattt
ataaactctcaccagagactacttattgtctaaaagttaaagcagcactacttacgtcat
ggaaaattggtgtctatagtccagtacattgtataaagaccacagttgaaaatgaactac
ctccaccagaaaatatagaagtcagtgtccaaaatcagaactatgttcttaaatgggatt
atacatatgcaaacatgacctttcaagttcagtggctccatttgtatttaggaggccga
ggtaggtggatcacctgaggtcaggagttcaagaccagcctggccaacatgacgaaaccc
catctctactaaaaatacaaaaattaggcaggcctggtggcgtgcacctgtaatcccagc
tactcaggggacagaggcaggagaattgcttgaacccaggaggcagaggttgcagtgag
ccaagatcctaccactccactccagcctgggtgacagagcgagactcggtctcaaaaaa
aagccaaaaaaataaaccagcttgcagcattcctggaaattctaactaacagatgttct
tgcatattgatatgagccacctccagcagagcacaacatgaccacagtctggaacagtct
ttggttttcttttatgttagatgcatatctcttccattgtttgtgagtttcctgagtgtg
gatactatttatttctgtaaccttagcccctaacatagtgtctggcaattgtaaatactt
aataaatatctaatgaatttaaa
```

Figure 16b

```
>T07758_P6 # Length: 269 #SW INR1_HUMAN

MVVLLGATTLVLVAVAPWVLSAAAGGKNLKSPQKVEVDIIDDNFILRWNRSDESVGNVTF
SFDYQKTGMDNWIKLSGCQNITSTKCNFSSLKLNVYEEIKLRIRAEKENTSSWYEVDSFT
PFRKAQIGPPEVHLEAEDKAIVIHISPGTKDSVMWALDGLSFTYSLVIWKNSSGVEERIE
NIYSRHKIYKLSPETTYCLKVKAALLTSWKIGVYSPVHCIKTTVENELPPPENIEVSVQN
QNYVLKWDYTYANMTFQVQWLHLYFRRPR
```

Figure 18

Alignment of T07758_P6 (SEQ ID NO: 17) to INR1_HUMAN (SEQ ID NO:132)

```
  1 MVVLLGATTLVLVAVAPWVLSAAAGGKNLKSPQKVEVDIIDDNFILRW  48
    ||||||||||||||| |||||||||||||||||||||||||||||||
  2 MVVLLGATTLVLVAVGPWVLSAAAGGKNLKSPQKVEVDIIDDNFILRW  49

49 NRSDESVGNVTFSFDYQKTGMDNWIKLSGCQNITSTKCNFSSLKLNVYEE  98
    |||||||||||||||||||||||||||||||||||||||||||||||||
 50 NRSDESVGNVTFSFDYQKTGMDNWIKLSGCQNITSTKCNFSSLKLNVYEE  99

99 IKLRIRAEKENTSSWYEVDSFTPFRKAQIGPPEVHLEAEDKAIVIHISPG 148
    |||||||||||||||||||||||||||||||||||||||||||||||||
100 IKLRIRAEKENTSSWYEVDSFTPFRKAQIGPPEVHLEAEDKAIVIHISPG 149

149 TKDSVMWALDGLSFTYSLVIWKNSSGVEERIENIYSRHKIYKLSPETTY 197
    ||||||||||||||||||| ||||||||||||||||||||||||||||
150 TKDSVMWALDGLSFTYSLLIWKNSSGVEERIENIYSRHKIYKLSPETTY 198

198 CLKVKAALLTSWKIGVYSPVHCIKTTVENELPPPENIEVSVQNQNYVLKW 247
    |||||||||||||||||||||||||||||||||||||||||||||||||
199 CLKVKAALLTSWKIGVYSPVHCIKTTVENELPPPENIEVSVQNQNYVLKW 248

248 DYTYANMTFQVQWLHLYFRRPR                            269
    ||||||||||||||
249 DYTYANMTFQVQWLH.......                            263
```

Figure 19

INR1 structure

W.T: | SP 1-27 | FN III-like 30-127 | FN III-like 129-230 | FN III-like 230-330 | FN III-like 334-427 | ▓ 437-457 | Cytoplasmic 458-557 |

T12: | SP 1-27 | FN III-like 30-127 | FN III-like 129-230 | FN III 231-269 (7 unique) ▓ 7 a.a |

CART – Cocaine- and amphetamine-regulated transcript

Figure 28a

CD154 skip3

```
   1 cttctctgcc agaagatacc atttcaactt taacacagca tgatcgaaac atacaaccaa
  61 acttctcccc gatctgcggc cactggactg cccatcagca tgaaaatttt tatgtattta
 121 cttactgttt ttcttatcac ccagatgatt gggtcagcac tttttgctgt gtatcttcat
 181 agaaggttgg acaagataga agatgaaagg aatcttcatg aagatttgt attcatgaaa
 241 acgatacaga gatgcaacac aggagaaaga tccttatcct tactgaactg tgaggagatt
 301 aaaagccagt ttgaaggctt tgtgaaggtg atcagaatcc tcaaattgcg gcacatgtca
 361 taagtgaggc cagcagtaaa acaacatctg tgttacagtg ggctgaaaaa ggatactaca
 421 ccatgagcaa caacttggta accctggaaa tgggaaaca gctgaccgtt aaaagacaag
 481 gactctatta tatctatgcc caagtcacct tctgttccaa tcgggaagct tgagtcaag
 541 ctccatttat agccagcctc tgcctaaagt cccccggtag attcgagaga atcttactca
 601 gagctgcaaa taccacagt tccgccaaac cttgcgggca acaatccatt cacttgggag
 661 gagtatttga attgcaacca ggtgcttcgg tgtttgtcaa tgtgactgat ccaagccaag
 721 tgagccatgg cactggcttc acgtcctttg gctactcaa actctgaaca gtgtcacctt
 781 gcaggctgtg gtggagctga cgctgggagt cttcataata cagcacagcg gttaagccca
 841 ccccctgtta actgcctatt tataacccta ggatcctcct tatggagaac tatttattat
 901 acactccaag gcatgtagaa ctgtaataag tgaattacag gtcacatgaa accaaaacgg
 961 gccctgctcc ataagagctt atatatctga agcagcaacc cactgatgc agacatccag
1021 agagtcctat gaaaagacaa ggccattatg cacaggttga attctgagta acagcagat
1081 aacttgccaa gttcagtttt gtttctttgc gtgcagtgtc tttccatgga taatgcattt
1141 gatttatcag tgaagatgca gaagggaaat ggggagcctc agctcacatt cagttatggt
1201 tgactctggg ttcctatggc cttgttggag ggggcaggc tctagaacgt ctaacacagt
1261 ggagaaccga aacccccccc cccccccgc caccctctcg gacagttatt cattctcttt
1321 caatctctct ctctccatct ctctctttca gtctctctct ctcaactct ttcttccaat
1381 ctctctttct caatctctct gtttcccttt gtcagtctct tccctcccc agtctctctt
1441 ctcaatcccc ctttctaaca cacacacaca cacacacaca cacacacaca cacacaca
1501 cacacacaca gagtcaggcc gttgctagtc agtctcttc tttccaccct gtccctatct
1561 ctaccactat agatgagggt gaggagtagg gagtgcagcc ctgagcctgc ccactcctca
1621 ttacgaaatg actgtattta aaggaaatct attgtatcta cctgcagtct ccattgtttc
1681 cagagtgaac ttgtaattat cttgttattt attttttgaa taataaagac ctcttaacat
1741 ta
```

Figure 28b

```
CD154-skip3 (106 aa)

MIETYNQTSPRSAATGLPISNKIFMYLLTVFLITQMIGSALFAV
YLHRRLDKIEDERNLHEDFVFMKTIQRCNTGERSLSLLNCEEIKSQFEGFVKVIRILKLRHMS
```

Figure 28c

```
Mutant CD154 from HIGM patient

MIETYNQTSPRSAATGLPISMKIFMYLLTVFLITQMIGSALFAV
YLHRRLDKIEDERNLHEDFVFMKTIQRCNTGERSLSLLNCEEIKSQFEGFVKVIRILKCGTC
```

Figure 28d

Alignment of the CD154 splice variant skipping exon 3(SEQ
ID NO:657) to the mRNA sequence derived from HIGM (hyper
IgM) syndrome patient

```
1    gagattaaaagccagtttgaaggctttgtgaaggtgatcagaatcctcaaa-tgcggcac  59
     |||||||||||||||||||||||||||||||||||||||||||||||||||| ||||||||
295  gagattaaaagccagtttgaaggctttgtgaaggtgatcagaatcctcaaattgcggcac  354

Query:  60  atgtc  64
            |||||
Sbjct: 355  atgtc  359
```

Figure 28e

CD154 skip4

```
   1 cttctctgcc agaagatacc atttcaactt taacacagca tgatcgaaac atacaaccaa
  61 acttctcccg gatctgcggc cactggactg cccatcagca tgaaasttct tatgtatcta
 121 cttactgttt tcttatcac ccagatgatt gggtcagcac ttttgctgt gtatcttcat
 181 agaaggttgg acaagataga agatgaaagg aatcttcatg aagattttgt attcatgaaa
 241 acgatacaga gatgcaacac aggagaaaga tcctatcct tactgaactg tgaggagatt
 301 aaaagccagt ttgaaggctt tgtgaaggat atastgttaa acaaagagga gacgaagaaa
 361 gaaaacagct ttgaaatgca aaasgtgtta cagtgggctg aaaaaggata ctacaccatg
 421 agcaacaact tggtaaccct ggaaaatggg aaacagctga cgttaaaag acaaggactc
 481 tattatatct atgcccaagt cacgttctgt tccaatggg aagcttcgag tcagctcca
 541 tttatagcca gctctgcct aaagtcccc ggtagatcg agagaatctt actcagagct
 601 gcaaataccc acagttccgc caaacctgc gggcaacaat ccattcactt ggaggagta
 661 tttgaattgc aaccaggtgc ttggtgttt gtcaatgtga ctgatccag ccaagtgagc
 721 catggcactg gttcacgtc ctttggctta ctcaaactct gaacagtgtc accttgcagg
 781 ctgtggtgga gctgacgctg ggagtcttca taatacagca cagcggttaa gccccaccc
 841 tgttaactgc ctatttataa ccctaggatc ctccttatgg agaactattt attatacact
 901 ccaaggcatg tagaactgta ataagtgaat tacaggtcac atgaaaccaa aacgggcct
 961 gctccatacg agcttatata tctgaagcag caacccact gatgcagca tccagagagt
1021 cctatgaaaa gacaaggcca ttatgcacag gttgaattct gagtaaacag cagataactt
1081 gccaagttca gttttgttttc ttgcgtgca gtgtcttcc atggataatg catttgattt
1141 atcagtgaag atgcagaagg gaaatgggga gcctcagtc acattgagct atggttgact
1201 ctggttcct atggccttgt tgaggggc caggtctag aacgtctaac acagtggaga
1261 acggaaaccc cccccccccc ccgccaccc tctggacag ttattcattc tctttcaatc
1321 tctctctctc catctctctc tttcagtctc tctctctcaa cctcttttctt ccaatctctc
1381 tttcaatc tctctgtttc cctttgtcag tctcttccct cccccagtct ctattcaa
1441 tccccctttc taacacacac acacacacac acacacacac acacacacac acacacacac
1501 acacagagtc aggcgttgc tagtcagttc tcttcttcc accctgtccc tatctctacc
1561 actacatg agggtgagga gtagggagtg cagcctgag cctgccact ctcattacg
1621 aaatgactgt atttaaagga aatctattgt atctacctgc agtctccatt gtttccagag
1681 tgaacttgta attatctgt tattttattc ttgaataata aagacctctt aacatta
```

Figure 28f

CD154-skip4

MIETYNQTSPRSAATGLPISMKIFMYLLTVFLITQMIGSALFAV
YLHRRLDKIEDERNLHEDFVFMKTIQRCNTGERSLSLLNCEEIKSQFEGFVKDIMLNK
EETKKENSFEMQKVLQWAEKGYYTMSNNLVTLENGKQLTVKRQGLYYIYAQVTFCSNR
EASSQAPFIASLCLKSPGRPERILLRAANTHSSAKPCGQQSIHLGGVFELQPGASFV
NVTDPSQVSHGTGFTSFGLLKL

Figure 29

WT vs Skip3

```
1 MIETYNQTSPRSAATGLPISMKIFMYLLTVFLITQMIGSALFAVYLHRRLDKIEDERNLH 60
  MIETYNQTSPRSAATGLPISMKIFMYLLTVFLITQMIGSALFAVYLHRRLDKIEDERNLH
1 MIETYNQTSPRSAATGLPISMKIFMYLLTVFLITQMIGSALFAVYLHRRLDKIEDERNLH 60

61  EDFVFMKTIQRCNTGERSLSLLNCEEIKSQFEGFVKDIMLNK 102
    EDFVFMKTIQRCNTGERSLSLLNCEEIKSQFEGFVK I + K
61  EDFVFMKTIQRCNTGERSLSLLNCEEIKSQFEGFVKVIRILKLRHMS 107
```

Figure 30

CD154-skip4 vs CD154-WT (X CD40 binding aa, XK Integrin binding aa)

```
Query: 1   MIETYNQTSPRSAATGLPISMKIFMYLLTVFLITQMIGSALFAVYLHRRLDKIEDERNLH 60
           MIETYNQTSPRSAATGLPISMKIFMYLLTVFLITQMIGSALFAVYLHRRLDKIEDERNLH
Sbjct: 1   MIETYNQTSPRSAATGLPISMKIFMYLLTVFLITQMIGSALFAVYLHRRLDKIEDERNLH 60

Query: 61  EDFVFMKTIQRCNTGERSLSLLNCEEIKSQFEGFVKDIMLNKEETKKENSFEMQK------ 115
           EDFVFMKTIQRCNTGERSLSLLNCEEIKSQFEGFVKDIMLNKEETKKENSFEMQK
Sbjct: 61  EDFVFMKTIQRCNTGERSLSLLNCEEIKSQFEGFVKDIMLNKEETKKENSFEMQKGDQNP 120

Query: 116 ----------------VLQWAEKGYYTMSNNLVTLENGKQLTVKRQGLYYIYAQVTFCSN 159
                           VLQWAEKGYYTMSNNLVTLENGKQLTVKRQGLYYIYAQVTFCSN
Sbjct: 121 QIAAHVISEASSKTTSVLQWAEKGYYTMSNNLVTLENGKQLTVKRQGLYYIYAQVTFCSN 180

Query: 160 REASSQAPFIASLCLKSPGRFERILLRAANTHSSAKPCGQQSIHLGGVFELQPGASVFVN 219
           REASSQAPFIASLCLKSPGRFERILLRAANTHSSAKPCGQQSIHLGGVFELQPGASVFVN
Sbjct: 181 REASSQAPFIASLCLKSPGRFERILLRAANTHSSAKPCGQQSIHLGGVFELQPGASVFVN 240

Query: 220 VTDPSQVSHGTGFTSFGLLKL 240
           VTDPSQVSHGTGFTSFGLLKL
Sbjct: 241 VTDPSQVSHGTGFTSFGLLKL 261

Figure 31a

Macaca nemestrina CD154

MIETYNQPSPRSAATGLPISMKIFMYLLTVFLITQMIGSALFAV
YLHRRLDKIEDERNLHEDFVPMKTIQRCNTGERSLSLLDCEEIKSQFEGFVKDIMLNK
EEKKKENSFEMQKVLQWAEKGYYTMSNNLVTLENGKQLTVKRQGLYYIYAQVTFCSNR
EASSQAPFIASLCLKSPGRFERILLRAANTHSSTKPCGQQSIHLGGVFELQPGASVFV
NVTDPSQVSHGTGFTSFGLLKL

Figure 31b

CD154-WT vs Macaca

```
Query:   1  MIETYNQPSPRSAATGLPVRMKIFMYLLTIFLITQMIGSALFAVYLHRRLDKIEDERNLH  60
            MIETYNQ SPRSAATGLP+ MKIFMYLLT+FLITQMIGSALFAVYLHRRLDKIEDERNLH
Sbjct:   1  MIETYNQTSPRSAATGLPISMKIFMYLLTVFLITQMIGSALFAVYLHRRLDKIEDERNLH  60

Query:  61  EDFVPMKTIQRCNTGERSLSLLDCEEIKSQFEGFVKDIMLNXXXXXXXNSFEMQK-----  115
            EDFVPMKTIQRCNTGERSLSLL+CEEIKSQFEGFVKDIMLN       NSFEMQK
Sbjct:  61  EDFVPMKTIQRCNTGERSLSLLNCEEIKSQFEGFVKDIMLNKEETKKENSFEMQKSDQNP  120

Query: 116  ----------------VLQWAEKGYYTMSNNLVTLENGKQLTVKRQGLYYIYAQVTFCSR  159
                            VLQWAEKGYYTMSNNLVTLENGKQLTVKRQGLYYIYAQVTFCSR
Sbjct: 121  QIAAHVISEASSKTTSVLQWAEKGYYTMSNNLVTLENGKQLTVKRQGLYYIYAQVTFCSR  180

Query: 160  REASSQAPFIASLCLKSPGRFERILLRAANTHSSTKPCGQQSIHLGGVFELQPGASVFVN  219
            REASSQAPFIASLCLKSPGRFERILLRAANTHSS KPCGQQSIHLGGVFELQPGASVFVN
Sbjct: 181  REASSQAPFIASLCLKSPGRFERILLRAANTHSSAKPCGQQSIHLGGVFELQPGASVFVN  240

Query: 220  VTDPSQVSRGTCFTSFGLLKL  240
            VTDPSQVSRGTCFTSFGLLKL
Sbjct: 241  VTDPSQVSRGTCFTSFGLLKL  261
```

Figure 31c

CD154-Skip4 vs Macaca nemestrina

```
Query:   1  MIETYNQPSPRSAATGLPVRMKIFMYLLTIFLITQMIGSALFAVYLHRRLDKIEDERNLH  60
            MIETYNQ SPRSAATGLP+ MKIFMYLLT+FLITQMIGSALFAVYLHRRLDKIEDERNLH
Sbjct:   1  MIETYNQTSPRSAATGLPISMKIFMYLLTVFLITQMIGSALFAVYLHRRLDKIEDERNLH  60

Query:  61  EDFVPMKTIQRCNTGERSLSLLDCEEIKSQFEGFVKDIMLNXXXXXXXNSFEMQKVLQWA  120
            EDFVPMKTIQRCNTGERSLSLL+CEEIKSQFEGFVKDIMLN       NSFEMQKVLQWA
Sbjct:  61  EDFVPMKTIQRCNTGERSLSLLNCEEIKSQFEGFVKDIMLNKEETKKENSFEMQKVLQWA  120

Query: 121  EKGYYTMSNNLVTLENGKQLTVKRQGLYYIYAQVTFCSNREASSQAPFIASLCLKSPGRF  180
            EKGYYTMSNNLVTLENGKQLTVKRQGLYYIYAQVTFCSNREASSQAPFIASLCLKSPGRF
Sbjct: 121  EKGYYTMSNNLVTLENGKQLTVKRQGLYYIYAQVTFCSNREASSQAPFIASLCLKSPGRF  180

Query: 181  ERILLRAANTHSSTKPCGQQSIHLGGVFELQPGASVFVNVTDPSQVSHGTGFTSFGLLKL  240
            ERILLRAANTHSS KPCGQQSIHLGGVFELQPGASVFVNVTDPSQVSHGTGFTSFGLLKL
Sbjct: 181  ERILLRAANTHSSAKPCGQQSIHLGGVFELQPGASVFVNVTDPSQVSHGTGFTSFGLLKL  240
```

Structure of CD154 (partial seq start from G116 probably the sheded form

```
>HUMELAM1A_T1 #LN 1061
GTGTTGAGCTGTTCTTGGCTGACTTCACATCAAAACTCCTATACTGACCTGAGACAGAGG
CAGCAGTGATACCCACCTGAGAGATCCTGTGTTTGAACAACTGCTTCCCAAAACGGAAAG
TATTTCAAGCCTAAACCTTTGGGTGAAAAGAACTCTTGAAGTCATGATTGCTTCACAGTT
TCTCTCAGCTCTCACTTTGGTGCTTCTCATTAAAGAGAGTGGAGCCTGGTCTTACAACAC
CTCCACGGAAGCTATGACTTATGATGAGGCCAGTGCTTATTGTCAGCAAAGGTACACACA
CCTGGTTGCAATTCAAAACAAGAAGAGATTGAGTACCTAAACTCCATATTGAGCTATTC
ACCAAGTTATTACTGGATTGGAATCAGAAAAGTCAACAATGTGTGGGTCTGGGTAGGAAC
CCAGAAACCTCTGACAGAAGAAGCCAAGAACTGGGCTCCAGGTGAACCCAACAATAGGCA
AAAAGATGAGGACTGCGTGGAGATCTACATCAAGAGAGAAAAAGATGTGGGCATGTGGAA
TGATGAGAGGTGCAGCAAGAAGAAGCTTGCCCTATGCTACACAGCTGCCTGTACCAATAC
ATCCTGCAGTGGCCACGGTGAATGTGTAGAGACCATCAATAATTACACTTGCAAGTGTGA
CCCTGGCTTCAGTGGACTCAAGTGTGAGCAAAGTAAGTCTGGTTCTTGCCTCTTTCTTCA
CTTGAGATGGTAGCACCATCTCACGTCCTAGCTGGCATTAGAGTCAGGTCTGCATGCCTT
CCCTTCCCTGGTGCAGATGGTGTCATATGGTGATCGTGAGCTGAGACTATGAAGTCAGAC
CCTGCTGGGTTTGAGTCCTAGATTCACCAGTTATTTATTTTGGCACCTTGACAAGATAGT
TTAACTCTCTATGTCAGTTTTCTCATTGTAAAATGAGGATAATAATAGTGTGAACTTCAT
AGGCTCATGGTTACATGGTGCCTGGCACACAGGACACATTCAATAAACTGTAATTCTGTG
TCCCTGCGAGGAACATGTACTCACCTCATCTAGGTGGTAAC
```

Figure 37b

```
>HUMELAM1A_P2
MIASQFLSALTLVLLIKESGAWSYNTSTEAMTYDEASAYCQQRYTHLVAIQNKEEIEYLN
SILSYSPSYYWIGIRKVNNVWVWVGTQKPLTEEAKNWAPGEPNNRQKDEDCVEIYIKREK
DVGMWNDERCSKKKLALCYTAACTNTSCSGHGECVETINNYTCKCDPGFSGLKCEQSKSG
SCLFLHLRW
```

Figure 39

Alignment between the E-Selectin new variant T1 product HUMELAM1A_P2 (SEQ ID NO:65) and wild type LEM2_HUMAN (SEQ ID NO:139)

```
  1 MIASQFLSALTLVLLIKESGAWSYNTSTEAMTYDEASAYCQQRYTHLVAI  50
    ||||||||||||||||||||||||||||||||||||||||||||||||||
  1 MIASQFLSALTLVLLIKESGAWSYNTSTEAMTYDEASAYCQQRYTHLVAI  50

51 QNKEEIEYLNSILSYSPSYYWIGIRKVNNVWVWVGTQKPLTEEAKNWAPG 100
    ||||||||||||||||||||||||||||||||||||||||||||||||||
 51 QNKEEIEYLNSILSYSPSYYWIGIRKVNNVWVWVGTQKPLTEEAKNWAPG 100

101 EPNNRQKDEDCVEIYIKREKDVGMWNDERCSKKKLALCYTAACTNTSCSG 150
    ||||||||||||||||||||||||||||||||||||||||||||||||||
101 EPNNRQKDEDCVEIYIKREKDVGMWNDERCSKKKLALCYTAACTNTSCSG 150

151 HGECVETINNYTCKCDPGFSGLKCEQSKSGSCLFLHLRW           189
    ||||||||||||||||||||||||||||
151 HGECVETINNYTCKCDPGFSGLKCEQ..............          176
```

Figure 41a

```
>MMPLNHR_T2 #LN 2509
AGGAGGAAGGGGAGGGAAAAGGGGAGGAGGAGGAGGATGTGAGACTGGGTTAGAGAAATG
AAAGAAAGCAAGGCTTTCTGTTGACATTCAGTGCAGTCTACCTGCAGCACAGCACACTCC
CTTTGGGCAAGGACCTGAGACCCTTGTGCTAAGTCAAGAGGCTCAATGGGCTGCAGAAGA
ACTAGAGAAGGACCAAGCAAAGCCATGATATTTCCATGGAAATGTCAGAGCACCCAGAGG
GACTTATGGAACATCTTCAAGTTGTGGGGGTGGACAATGCTCTGTTGTGATTCCTGGCA
CATCATGGAACCGACTGCTGGACTTACCATTATTCTGAAAAACCCATGAACTGGCAAAGG
GCTAGAAGATTCTGCCGAGACAATTACACAGATTTAGTTGCCATACAAAACAAGGCGGAA
ATTGAGTATCTGGAGAAGACTCTGCCTTTCAGTCGTTCTTACTACTGGATAGGAATCCGG
AAGATAGGAGGAATATGGACGTGCGTGGGAACCAACAAATCTCTTACTGAAGAAGCAGAG
AACTGGGGAGATGGTGAGCCCAACAACAAGAAGAACAAGGAGGACTGCGTGGAGATCTAT
ATCAAGAGAAACAAAGATGCAGGCAAATGGAACGATGACGCCTGCCACAAACTAAAGGCA
GCCCTCTGTTACACAGCTTCTTGCCAGCCCTGGTCATGCAGTGGCCATGGAGAATGTGTA
GAAATCATCAATAATTACACCTGCAACTGTGATGTGGGGTACTATGGGCCCCAGTGTCAG
TTTGTGATTCAGTGTGAGCCTTTGGAGGCCCCAGAGCTGGGTACCATGGACTGTACTCAC
CCTTTGGGAAACTTCAGCTTCAGCTCACAGTGTGCCTTCAGCTGCTCTGAAGGAACAAAC
TTAACTGGGATTGAAGAAACCACCTGTGGACCATTTGGAAACTGGTCATCTCCAGAACCA
ACCTGTCAAGGAGAATAACAACTGAAAAACAAAAACACAATCTCTTGATCTTTTCAAGTT
TGAAATAAGTGATTCAGTGTGAGCCTCTATCAGCACCAGATTTGGGGATCATGAACTGTA
GCCATCCCCTGGCCAGCTTCAGCTTTACCTCTGCATGTACCTTCATCTGCTCAGAAGGAA
CTGAGTTAATTGGGAAGAAGAAAACCATTTGTGAATCATCTGGAATCTGGTCAAATCCTA
GTCCAATATGTCAAAAATTGGACAAAAGTTTCTCAATGATTAAGGAGGGTGATTATAACC
CCCTCTTCATTCCAGTGGCAGTCATGGTTACTGCATTCTCTGGGTTGGCATTTATCATTT
GGCTGGCAAGGAGATTAAAAAAAGGCAAGAAATCCAAGAGAAGTATGAATGACCCATATT
AAATCGCCCTTGGTGAAAGAAAATTCTTGGAATACTAAAAATCATGAGATCCTTTAAATC
CTTCCATGAAACGTTTTGTGTGGTGGCACCTCCTACGTCAAACATGAAGTGTGTTTCCTT
CAGTGCATCTGGGAAGATTTCTACCTGACCAACAGTTCCTTCAGCTTCCATTTCGCCCCT
CATTTATCCCTCAACCCCCAGCCCACAGGTGTTTATACAGCTCAGCTTTTTGTCTTTTCT
GAGGAGAAACAAATAAGACCATAAAGGGAAAGGATTCATGTGGAATATAAAGATGGCTGA
CTTTGCTCTTTCTTGACTCTTGTTTTCAGTTTCAATTCAGTGCTGTACTTGATGACAGAC
ACTTCTAAATGAAGTGCAAATTTGATACATATGTGAATATGGACTCAGTTTTCTTGCAGA
TCAAATTTCACGTCGTCTTCTGTATACTGTGGAGGTACACTCTTATAGAAAGTTCAAAAA
GTCTACGCTCTCCTTTCTTTCTAACTCCAGTGAAGTAATGGGGTCCTGCTCAAGTTGAAA
GAGTCCTATTTGCACTGTAGCCTCGCCGTCTGTGAATTGGACCATCCTATTTAACTGGCT
TCAGCCTCCCCACCTTCTTCAGCCACCTCTCTTTTTCAGTTGGCTGACTTCCACACCTAG
CATCTCATGAGTGCCAAGCAAAAGGAGAGAAGAGAGAAATAGCCTGCGCTGTTTTTTAGT
TTGGGGGTTTTGCTGTTCCTTTTATGAGACCCATTCCTATTTCTTATAGTCAATGTTTC
TTTTATCACGATATTATTAGTAAGAAAAACATCACTGAAATGCTAGCTGCAAGTGACATCT
CTTTGATGTCATATGGAAGAGTTAAAAACAGGTGGAGAAATTCCTTGATTCACAATGAAAT
GCTCTCCTTTCCCCTGCCCCCAGACCTTTTATCCACTTACCTAGATTCTACATATTCTTT
AAATTTCATCTCAGGCCTCCCTCAACCCCACCACTTCTTTTATAACTAGTCCTTTACTAA
TCCAACCCATGATGAGCTCCTCTTCCTGGCTTCTTACTGAAAGGTTACCCTGTAACATGC
AATTTTGCATTTGAATAAAGCCTGCTTTTAAGTGTAAAAAAAAAAAA
```

Figure 41b

```
>MMPLNHR_P2
MIFPWKCQSTQRDLWNIEKLWGWTMLCCDFLAHEGTDCWTYHYSEKP
MNWQRARRFCRDNYTDLVAIQNKAEIEYLEKTLPFSRSYYWIGIRKIGGIWTWVGTNKSL
TEEAENWGDGEPNNKKNKEDCVEIYIKRNKDAGKWNDDACHKLKAALCYTASCQPWSCSG
BGECVEIINNYTCNCDVGYYGPQCQFVIQCEPLEAPELGTMDCTHPLGNFSFSSQCAFSC
SEGTNLTGIEETTCGPFGNWSSPEPTCQGW
```

Figure 41c

>MMPLNHR_T3 #LN 2321(SEQ ID NO:72) NEW EDGE ] [
AGGAGGAAGGGGAGGGAAAAGGGGAGGAGGAGGAGGATGTGAGACTGGGTTAGAGAAATG
AAAGAAAGCAAGGCTTTCTGTTGACATTCAGTGCAGTCTACCTGCAGCACAGCACACTCC
CTTTGGGCAAGGACCTGAGACCCTTGTGCTAAGTCAAGAGGCTCAATGGGCTGCAGAAGA
ACTAGAGAAGGACCAAGCAAAGCCATGATATTTCCATGGAAATGTCAGAGCACCCAGAGG
GACTTATGGAACATCTTCAAGTTGTGGGGGTGGACAATGCTCTGTTGTGATTTCCTGGCA
CATCATGGAACCGACTGCTGGACTTACCATTATTCTGAAAAACCCATGAACTGGCAAAGG
GCTAGAAGATTCTGCCGAGACAATTACACAGATTTAGTTGCCATACAAAACAAGGCGGAA
ATTGAGTATCTGGAGAAGACTCTGCCTTTCAGTCGTTCTTACTACTGGATAGGAATCCGG
AAGATAGGAGGAATATGGACGTGGGTGGGAACCAACAAATCTCTTACTGAAGAAGCAGAG
AACTGGGGAGATGGTGAGCCCAACAACAAGAAGAACAAGGAGGACTGCGTGGAGATCTAT
ATCAAGAGAAACAAAGATGCAGGCAAATGGAACGATGACGCCTGCCACAAACTAAAGGCA
GCCCTCTGTTACACAGCTTCTTGCCAGCCCTGGTCATGCAGTGGCCATGGAGAATGTGTA
GAAATCATCAATAATTACACCTGCAACTGTGATGTGGGGTACTATGGGCCCCAGTGTCAG
TTTGTGATTCAGTGTGAGCCTTTGGAGGCCCCAGAGCTGGGTACCATGGACTGTACTCAC
CCTTTGGGAAACTTCAGCTTCAGCTCACAGTGTGCCTTCAGCTGCTCTGAAGGAACAAAC
TTAACTGGGATTGAAGAAACCACCTGTGGACCATTTGGAAACTGGTCATCTCCAGAACCA
ACCTGTCAAGTGATTCAGTGTGAGCCTCTATCAGCACCAGATTTGGGGATCATGAACTGT
AGCCATCCCCTGGCCAGCTTCAGCTTTACCTCTGCATGTACCTTCATCTGCTCAGAAGGA
ACTGAGTTAATTGGGAAGAAGAAAACCATTTGTGAATCATCTGGAATCTGGTCAAATCCT
AGTCCAATATGTCAAA] [GCAAGAAATCCAAGAGAAGTATGAATGACCCATATTAAATCGCC
CTTGGTGAAAGAAAATTCTTGGAATACTAAAAATCATGAGATCCTTTAAATCCTTCCATG
AAACGTTTTGTGTGGTGGCACCTCCTACGTCAAACATGAAGTGTGTTTCCTTCAGTGCAT
CTGGGAAGATTTCTACCTGACCAACAGTTCCTTCAGCTTCCATTTCGCCCCTCATTTATC
CCTCAACCCCCAGCCCACAGGTGTTTATACAGCTCAGCTTTTTGTCTTTTCTGAGGAGAA
ACAAATAAGACCATAAAGGGAAAGGATTCATGTGGAATATAAAGATGGCTGACTTTGCTC
TTTCTTGACTCTTGTTTTCAGTTTCAATTCAGTGCTGTACTTGATGACAGACACTTCTAA
ATGAAGTGCAAATTTGATACATATGTGAATATGGACTCAGTTTTCTTGCAGATCAAATTT
CACGTCGTCTTCTGTATACTGTGGAGGTACACTCTTATAGAAAGTTCAAAAAGTCTACGC
TCTCCTTTCTTTCTAACTCCAGTGAAGTAATGGGGTCCTGCTCAAGTTGAAAGAGTCCTA
TTTGCACTGTAGCCTCGCCGTCTGTGAATTGGACCATCCTATTTAACTGGCTTCAGCCTC
CCCACCTTCTTCAGCCACCTCTCTTTTCAGTTGGCTGACTTCCACACCTAGCATCTCAT
GAGTGCCAAGCAAAAGGAGAGAAGAGAGAAATAGCCTGCGCTGTTTTTAGTTTGGGGGT
TTTGCTGTTTCCTTTTATGAGACCCATTCCTATTTCTTATAGTCAATGTTTCTTTTATCA
CGATATTATTAGTAAGAAAACATCACTGAAATGCTAGCTGCAAGTGACATCTCTTTGATG
TCATATGGAAGAGTTAAAACAGGTGGAGAAATTCCTTGATTCACAATGAAATGCTCTCCT
TTCCCCTGCCCCCAGACCTTTTATCCACTTACCTAGATTCTACATATTCTTTAAATTTCA
TCTCAGGCCTCCCTCAACCCCACCACTTCTTTTATAACTAGTCCTTTACTAATCCAACCC
ATGATGAGCTCCTCTTCCTGGCTTCTTACTGAAAGGTTACCCTGTAACATGCAATTTTGC
ATTTGAATAAAGCCTGCTTTTTAAGTGTTAAAAAAAAAAAA

Figure 41d

>MMPLNHR_P3 (SEQ ID NO:71) NEW EDGE] [

MIFPWKCQSTQRDLWNIFKLWGWTMLCCDFLAHHGTDCWTYHYSEKP
MNWQRARRFCRDNYTDLVAIQNKAEIEYLEKTLPFSRSYYWIGIRKIGGIWTWVGTNKSL
TEEEAENWGDGEPNNKKNKEDCVEIYIKRNKDAGKWNDDACHKLKAALCYTASCQPWSCSG
HGECVEIINNYTCNCDVGYYGPQCQFVIQCEPLEAPELGTMDCTHPLGNFSFSSQCAFSC
SEGTNLTGIEETTCGPFGNWSSPEPTCQVIQCEPLSAPDLGIMNCSHPLASFSFTSACTF
ICSEGTELIGKKKTICESSGIWSNPSPICQS] [KKSKRSMNDPY

Figure 41e

```
>MMPLNHR_T6 #LN 1772
AGGAGGAAGGGGAGGGAAAAGGGGAGGAGGAGGAGGATGTGAGACTGGGTTAGAGAAATG
AAAGAAAGCAAGGCTTTCTGTTGACATTCAGTGCAGTCTACCTGCAGCACAGCACACTCC
CTTTGGGCAAGGACCTGAGACCCTTGTGCTAAGTCAAGAGGCTCAATGGGCTGCAGAAGA
ACTAGAGAAGGACCAAGCAAAGCCATGATATTTCCATGGAAATGTCAGAGCACCCAGAGG
GACTTATGGAACATCTTCAAGTTGTGGGGGTGGACAATGCTCTGTTGTGATTTCCTGGCA
CATCATGGAACCGACTGCTGGACTTACCATTATTCTGAAAAACCCATGAACTGGCAAAGG
GCTAGAAGATTCTGCCGAGACAATTACACAGATTTAGTTGCCATACAAAACAAGGCGGAA
ATTGAGTATCTGGAGAAGACTCTGCCTTTCAGTCGTTCTTACTACTGGATAGGAATCCGG
AAGATAGGAGGAATATGGACGTGGGTGGGAACCAACAAATCTCTTACTGAAGAAGCAGAG
AACTGGGGAGATGGTGAGCCCAACAACAAGAAGAACAAGGAGGACTGCGTGGAGATCTAT
ATCAAGAGAAACAAAGATGCAGGCAAATGGAACGATGACGCCTGCCACAAACTAAAGGCA
GCCCTCTGTTACACAGCTTCTTGCCAGCCCTGGTCATGCAGTGGCCATGGAGAATGTGTA
GAAATCATCAATAATTACACCTGCAACTGTGATGTGGGGTACTATGGGCCCCAGTGTCAG
TTTGTGATTCAGTGTGAGCCTTTGGAGGCCCCAGAGCTGGGTACCATGGACTGTACTCAC
CCTTTGGGAAACTTCAGCTTCAGCTCACAGTGTGCCTTCAGCTGCTCTGAAGGAACAAAC
TTAACTGGGATTGAAGAAACCACCTGTGGACCATTTGGAAACTGGTCATCTCCAGAACCA
ACCTGTCAAGTGATTCAGTGTGAGCCTCTATCAGCACCAGATTTGGGGATCATGAACTGT
AGCCATCCCCTGGCCAGCTTCAGCTTTACCTCTGCATGTACCTTCATCTGCTCAGAAGGA
ACTGAGTTAATTGGGAAGAAGAAAACCATTTGTGAATCATCTGGAATCTGGTCAAATCCT
AGTCCAATATGTCAAAGTGAGTAAGTTTGTCCTGGAAAACTGAAATCTTAACGATGGAGC
TGATGGATGAGCAGATATGAGGAAAGACATACATAAACATTTACATGTTGTTTTGCTAAG
AATATGTGGCCTAGAAATAAATTTGTATGCTTAACTCACTGTAAAATCTTTGGCTGGTCT
TTCCTCCTCCTTTAATGACAATCATTTCCTTTTTTTGTTCTCACCTCTTGCCATCTTAAC
TCCTAAAATCTGAACTCACTGATTTACTTTTTACCCATTCTTCTATTCCACTACAATCTA
ACATCTCTGTTAGCCCATTGAAATGCCTGTAAAAGGTCACTAATGACCACCTACTTCCCC
AAATAATGGATACTCCTGAATCATCACTAAGCTAATGCCTCCAAAATCTATCTGTATATG
AGAAGAATCATGTCTTGTTCATCTTTGTATACCCTCCACCTGACACAGTGCCTGGCAATA
GGTGCTAAAGCAAATGCATGTTAAGCTAGCATGTGAAAGAATAGCTACCTGTGTCTGCTC
CTGAGACTATCTGCATGGATGACAAAAGTCTTTAAATGGTAGGATCTACAGAAGCTGTCA
GAAATGCTGATCTCTGTGTGCTGCGTGCCCAG
```

Figure 41f

```
>MMPLNHR_P6
MIFPWKCQSTQRDLWNIFKLWGWTMLCCDFLAHHGTDCWTYHYSEKP
MNWQRARRFCRDNYTDLVAIQNKAEIEYLEKTLPFSRSYYWIGIRKIGGIWTWVGTNKSL
TEEAENWGDGEPNNKKNKEDCVEIYIKRNKDAGKWNDDACHKLKAALCYTASCQPWSCSG
HGECVEIINNYTCNCDVGYYGPQCQFVIQCEPLEAPELGTMDCTHPLGNFSFSSQCAFSC
SEGTNLTGIEETTCGPFGNWSSPEPTCQVIQCEPLSAPDLGIMNCSHPLASFSFTSACTF
ICSEGTELIGKKKTICESSGIWSNPSPICQSE
```

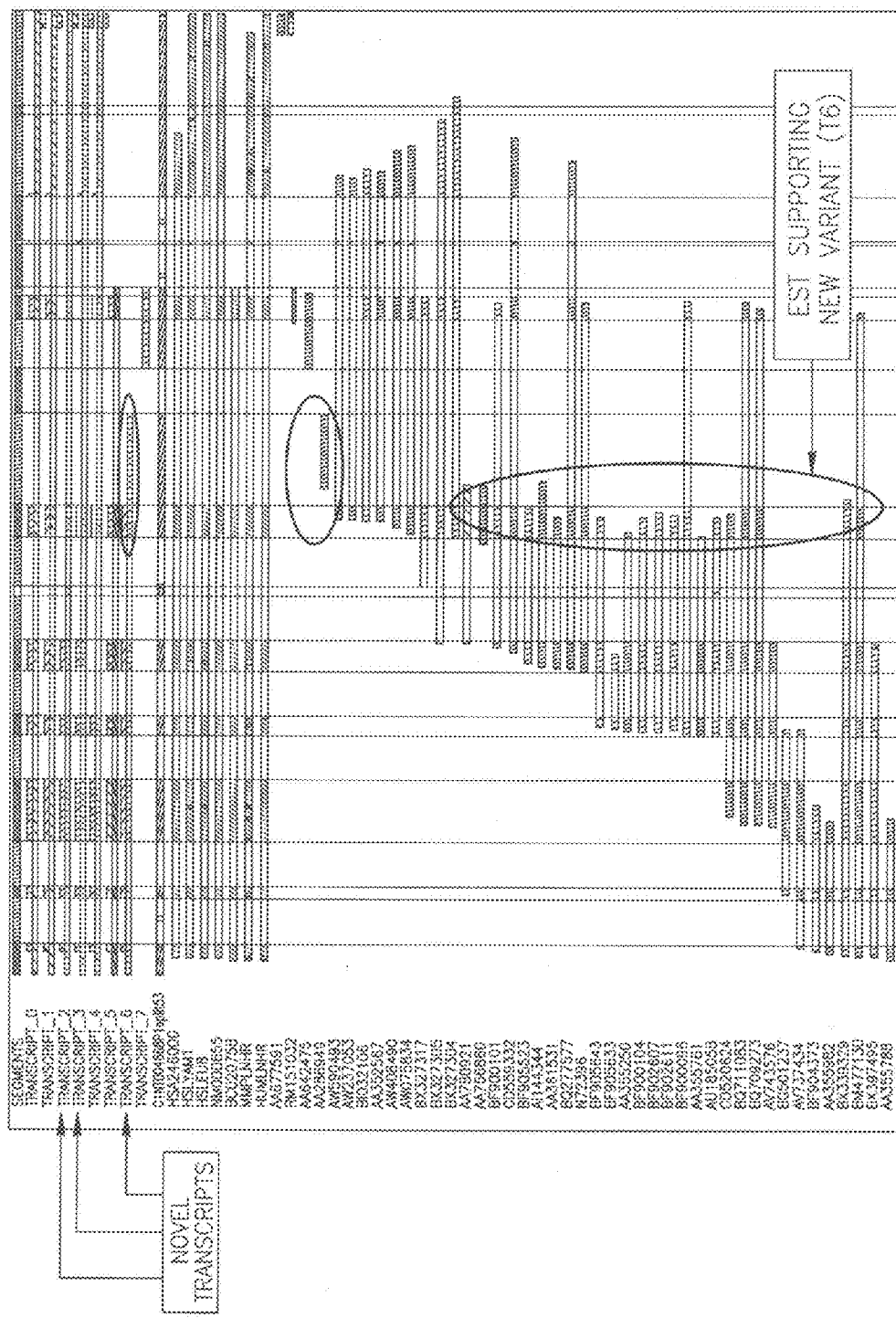

Figure 43a

Alignment of the L-Selectin new variant T2 product (SEQ ID NO:68) to LEM1_HUMAN (SEQ ID NO:140)

```
  1 MIFPWKCQSTQRDLWNIFKLWGWTMLCCDFLAHHGTDCWTYHYSEKPMNW  50
    ||||||||||||||||||||||||||||||||||||||||||||||||||
 14 MIFPWKCQSTQRDLWNIFKLWGWTMLCCDFLAHHGTDCWTYHYSEKPMNW  63

51 QRARRFCRDNYTDLVAIQNKAEIEYLEKTLPFSRSYYWIGIRKIGGIWTW 100
    |||||||||||||||||||||||||||||||||||||||||||||||||
 64 QRARRFCRDNYTDLVAIQNKAEIEYLEKTLPFSRSYYWIGIRKIGGIWTW 113

101 VGTNKSLTEEAENWGDGEPNNKKNKEDCVEIYIKRNKDAGKWNDDACHKL 150
    |||||||||||||||||||||||||||||||||||||||||||||||||
114 VGTNKSLTEEAENWGDGEPNNKKNKEDCVEIYIKRNKDAGKWNDDACHKL 163

151 KAALCYTASCQPWSCSGHGECVEIINNYTCNCDVGYYGPQCQFVIQCEPL 200
    |||||||||||||||||||||||||||||||||||||||||||||||||
164 KAALCYTASCQPWSCSGHGECVEIINNYTCNCDVGYYGPQCQFVIQCEPL 213

201 EAPELGTMDCTHPLGNFSFSSQCAFSCSEGTNLTGIEETTCGPFG      245
    ||||||||||| |||||||||||||||||||||||||||||||||
214 EAPELGTMDCTHSLGNFSFSSQCAFSCSEGTNLTGIEETTCGPFG      258

246 NWSSPEPTCQGE                                      257
    ||||||||||
259 NWSSPEPTCQ..                                      268
```

Figure 43b

Alignment of the L-Selectin variant T3 (SEQ ID NO:71) and the wild type protein LEM1_HUMAN (SEQ ID NO:140)

```
  1 MIFPWKCQSTQRDLWNIFKLWGWTMLCCDFLAHHGTDCWTYHYSEKPMNW  50
    ||||||||||||||||||||||||||||||||||||||||||||||||||
  1 MIFPWKCQSTQRDLWNIFKLWGWTMLCCDFLAHHGTDCWTYHYSEKPMNW  50

51 QRARRFCRDNYTDLVAIQNKAEIEYLEKTLPFSRSYYWIGIRKIGGIWTW 100
    ||||||||||||||||||||||||||||||||||||||||||||||||||
 51 QRARRFCRDNYTDLVAIQNKAEIEYLEKTLPFSRSYYWIGIRKIGGIWTW 100

101 VGTNKSLTEEAENWGDGEPNNKKNKEDCVEIYIKRNKDAGKWNDDACHKL 150
    ||||||||||||||||||||||||||||||||||||||||||||||||||
101 VGTNKSLTEEAENWGDGEPNNKKNKEDCVEIYIKRNKDAGKWNDDACHKL 150

151 KAALCYTASCQPWSCSGHGECVEIINNYTCNCDVGYYGPQCQFVIQCEPL 200
    ||||||||||||||||||||||||||||||||||||||||||||||||||
151 KAALCYTASCQPWSCSGHGECVEIINNYTCNCDVGYYGPQCQFVIQCEPL 200

201 EAPELGTMDCTHPLGNFSFSSQCAFSCSEGTNLTGIEETTCGPFGNWSSP 250
    ||||||||||| ||||||||||||||||||||||||||||||||||||||
201 EAPELGTMDCTHSLGNFSFSSQCAFSCSEGTNLTGIEETTCGPFGNWSSP 250

251 EPTCQVIQCEPLSAPDLGIMNCSHPLASFSFTSACTFICSEGTELIGKKK 300
    ||||||||||||||||||||||||||||||||||||||||||||||||||
251 EPTCQVIQCEPLSAPDLGIMNCSHPLASFSFTSACTFICSEGTELIGKKK 300

301 TICESSGIWSNPSPICQS................................ 318
    ||||||||||||||||||
301 TICESSGIWSNPSPICQKLDKSFSMIKEGDYNPLFIPVAVMVTAFSGLAF 350

319 ...........KKSKRSMNDPY                             329
               ||||||||||
346 IIWLARRLKKGKKSKRSMNDPY                             372
```

Figure 43c

Alignment of the L-Selectin variant T6 (SEQ ID NO:74) and the wild type protein LEM1_HUMAN (SEQ ID NO:140)

```
  1 MIFPWKCQSTQRDLWNIFKLWGWTMLCCDFLAHHGTDCWTYHYSEKPMNW  50
    ||||||||||||||||||||||||||||||||||||||||||||||||||
  1 MIFPWKCQSTQRDLWNIFKLWGWTMLCCDFLAHHGTDCWTYHYSEKPMNW  50

51 QRARRFCRDNYTDLVAIQNKAEIEYLEKTLPFSRSYYWIGIRKIGGIWTW 100
    ||||||||||||||||||||||||||||||||||||||||||||||||||
 51 QRARRFCRDNYTDLVAIQNKAEIEYLEKTLPFSRSYYWIGIRKIGGIWTW 100

101 VGTNKSLTEEAENWGDGEPNNKKNKEDCVEIYIKRNKDAGKWNDDACHKL 150
    ||||||||||||||||||||||||||||||||||||||||||||||||||
101 VGTNKSLTEEAENWGDGEPNNKKNKEDCVEIYIKRNKDAGKWNDDACHKL 150

151 KAALCYTASCQPWSCSGHGECVEIINNYTCNCDVGYYGPQCQFVIQCEPL 200
    ||||||||||||||||||||||||||||||||||||||||||||||||||
151 KAALCYTASCQPWSCSGHGECVEIINNYTCNCDVGYYGPQCQFVIQCEPL 200

201 EAPELGTMDCTHPLGNFSFSSQCAFSCSEGTNLTGIEETTCGPFGNWSSP 250
    |||||||||||  |||||||||||||||||||||||||||||||||||||
201 EAPELGTMDCTHSLGNFSFSSQCAFSCSEGTNLTGIEETTCGPFGNWSSP 250

250 EPTCQVIQCEPLSAPDLGIMNCSHPLASFSFTSACTFICSEGTELIGKKK 300
    ||||||||||||||||||||||||||||||||||||||||||||||||||
250 EPTCQVIQCEPLSAPDLGIMNCSHPLASFSFTSACTFICSEGTELIGKKK 300

301 TICESSGIWSNPSPICQSE                                319
    |||||||||||||||||||
301 TICESSGIWSNPSPICQ..                                317
```

Figure 45a

```
>HUMLAFA_T8 #SNP 2 G=>C
TYGTTTCTGCCCTTCTTTGCTTTGGTGGCTTCCTTGTGGTTCCTCAGTGGTGCCTGCAA
CCCCTGGTTCACCTCCTTCCAGGTTCTGGCTCCTTCCAGCCATGGCTCTCAGAGTCCTTC
TGTTAACAGCCTTGACCTTATGTCATGGGTTCAACTTGGACACTGAAAACGCAATGACCT
TCCAAGAGAACGCAAGGGGCTTCGGGCAGAGCGTGGTCCAGCTTCAGGGATCCAGGGTGG
TGGTTGGAGCCCCCAGGAGATAGTGGCTGCCAACCAAAGGGGCAGCCTCTACCAGTGCG
ACTACAGCACAGGCTCATGCGAGCCCATCCGCCTGCAGGTCCCCGTGGAGGCCGTGAACA
TGTCCCTGGGCCTGTCCCTGGCAGCCACCACCAGCCCCCCTCAGCTGCTGGCCTGTGGTC
CCACCGTGCACCAGACTTGCAGTGAGAACACGTATGTGAAAGGGCTCTGCTTCCTGTTTG
GATCCAACCTACGGCAGCAGCCCCAGAAGTTCCCAGAGGCCCTCCGAGGGTGTCCTCAAG
AGGATAGTGACATTGCCTTCTTGATTGATGGCTCTGGTAGCATCATCCCACATGACTTTC
GGCGGATGAAGGAGTTTGTCTCAACTGTGATGGAGCAATTAAAAAAGTCCAAAACCTTGT
TCTCTTTGATGCAGTACTCTGAAGAATTCCGGATTCACTTTACCTTCAAAGAGTTCCAGA
ACAACCCTAACCCAAGATCACTGGTGAAGCCAATAACGCAGCTGCTTGGGCGGACACACA
CGGCCACGGGCATCCGCAAAGTGGTACGAGAGCTGTTTAACATCACCAACGGAGCCCGAA
AGAATGCCTTTAAGATCCTAGTTGTCATCACGGATGGAGAAAAGTTTGGCGATCCCTTGG
GATATGAGGATGTCATCCCTGAGGCAGACAGAGAGGGAGTCATTCGCTACGTCATTGGGG
TAGGGAATGCAGCTCTCAGGTTGATGCTTCTGTGGAGGGTTTCTATGTGGATCCATCCTC
CCTTCAATTTGCAAATATTATTAAAATCAAAGTGACATGAGAGCTAATGCTAGCTCATAT
ACACCGTATCAGCTATCTGTTGCCACATCAATGCTGTGTAATAAA
```

Figure 45b

```
>HUMLAPA_P8
MALRVLLLTALTLCHGFNLDTENAMTFQENARGFGQSVVQLQGSRVVGAPQEIVAANQR
GSLYQCDYSTGSCEPIRLQVPVEAVNMSLGLSLAATTSPPQLLACGPTVHQTCSENTYVK
GLCFLFGSNLRQQPQKFPEALRGCPQEDSDIAFLIDGSGSIIPHDFRRMKEFVSTVMEQL
KKSKTLFSLMQYSEEFRIHFTFKEFQNNPNPRSLVKPITQLLGRTHTATGIRKVVRELFN
ITNGARKNAFKILVVITDGEKFGDPLGYEDVIPEADREGVIRYVIGVGNAALRIMLLWRV
SMWIHPPFNLQILLKSK
```

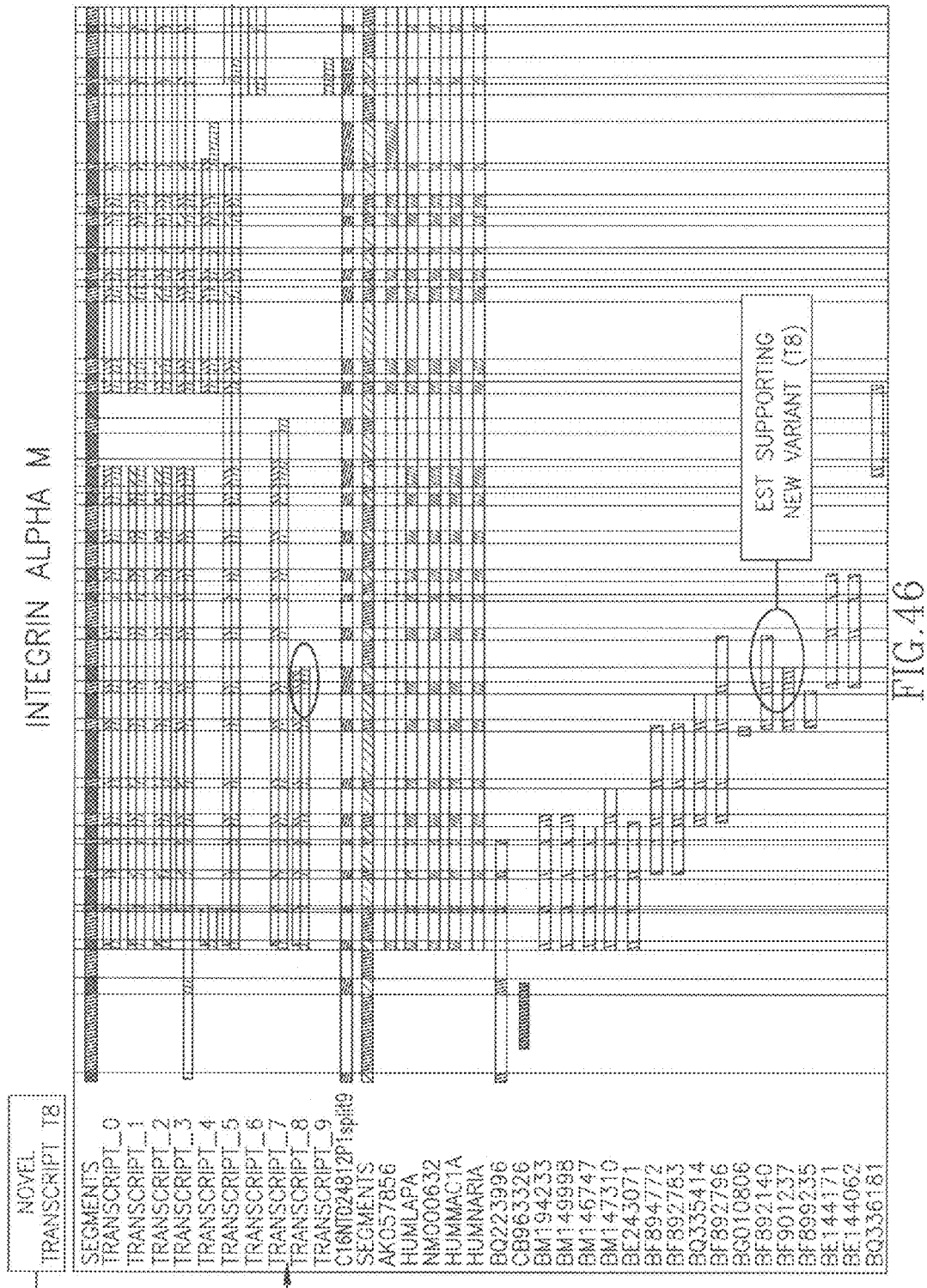

Figure 47

Alignment of the Integrin alpha M variant T11 HUMLAPA_P8 (SEQ ID NO:77) product to the wild type protein ITAM_HUMAN (SEQ ID NO:141)

```
  1 MALRVLLLTALTLCHGFNLDTENAMTFQENARGFGQSVVQLQGSRVVVGA  50
    ||||||||||||||||||||||||||||||||||||||||||||||||||
  1 MALRVLLLTALTLCHGFNLDTENAMTFQENARGFGQSVVQLQGSRVVVGA  50

51 PQEIVAANQRGSLYQCDYSTGSCEPIRLQVPVEAVNMSLGLSLAATTSPP 100
    ||||||||||||||||||||||||||||||||||||||||||||||||||
 51 PQEIVAANQRGSLYQCDYSTGSCEPIRLQVPVEAVNMSLGLSLAATTSPP 100

101 QLLACGPTVHQTCSENTYVKGLCFLFGSNLRQQPQKFPEALRGCPQEDSD 150
    ||||||||||||||||||||||||||||||||||||||||||||||||||
101 QLLACGPTVHQTCSENTYVKGLCFLFGSNLRQQPQKFPEALRGCPQEDSD 150

151 IAFLIDGSGSIIPHDFRRMKEFVSTVMEQLKKSKTLFSLMQYSEEFRIHF 200
    ||||||||||||||||||||||||||||||||||||||||||||||||||
151 IAFLIDGSGSIIPHDFRRMKEFVSTVMEQLKKSKTLFSLMQYSEEFRIHF 200

201 TFKEFQNNPNPRSLVKPITQLLGRTHTATGIRKVVRELFNITNGARKNAF 250
    ||||||||||||||||||||||||||||||||||||||||||||||||||
201 TFKEFQNNPNPRSLVKPITQLLGRTHTATGIRKVVRELFNITNGARKNAF 250

251 KILVVITDGEKFGDPLGYEDVIPEADREGVIRYVIGVGNAALRLMLLWRV 300
    |||||||||||||||||||||||||||||||||||
251 KILVVITDGEKFGDPLGYEDVIPEADREGVIRYVIGVG............ 288

301 SMWIHPPFNLQILLKSK                                 317

```
>TB3460_T11 #SNP 0 G=>C 795 C=>T 2134 T=>.
GAGTGTCACCAGCCTGTTGCCTCTGTGAGAAAGTACCACTGTAAGAGGCCAAAGGGCATG
ATCATTTCCTCTTTCACCCTGTCTAGGTTGCCAGCAAATCCCACGGGCCTCCTGACGCT
GCCCCTGGGGCCACAGGTCCCTCGAGTGCTGGAAGGATGAAGGATTCCTGCATCACTGTG
ATGGCCATGGCGCTGCTGTCTGGGTTCTTTTCTTCGCGCCGGCCTCGAGCTACAACCTG
GACGTGCGGGCGCGCGGAGCTTCTCCCCACCGCGCGCCGGGAGGCACTTTGGATACCGC
GTCCTGCAGGTCGGAAACGGGGTCATCGTGGGAGCTCCAGGGGAGGGAACAGCACAGGA
AGCCTCTATCAGTGCCAGTCGGGCACAGGACACTGCCTGCCAGTCACCCTGAGAGGTTCC
AACTATACCTCCAAGTACTTGGGAATGACCTTGGCAACAGACCCCACAGATGGAAGCATT
TTGGCCTGTGACCCTGGGCTGTCTCGAACGTGTGACCAGAACACCTATCTGAGTGGCCTG
TGTTACCTCTTCCGCCAGAATCTGCAGGGTCCCATGCTGCAGGGGCGCCCTGGTTTTCAG
GAATGTATCAAGGGCAACGTAGACCTGGTATTTCTGTTTGATGGTTCGATGAGCTTGCAG
CCAGATGAATTTCAGAAAATTCTGGACTTCATGAAGGATGTGATGAAGAAACTCAGCAAC
ACTTCGTACCAGTTGCTGCTGTTCAGTTTTCCACAAGCTACAAAACAGAATTTGATTTC
TCAGATTATGTTAAACGGAAGGACCCTGATGCTCTGCTGAAGCATGTAAAGCACATGTTG
CTGTTGACCAATACCTTTGGTGCCATCAATTATGTCGCGACAGAGGTGTTCCGGGAGGAG
CTGGGGCCCGGCCAGATGCCACCAAAGTGCTTATCATCATCACGGATGGGGAGGCCACT
GACAGTGGCAACATCGATGCGGCCAAAGACATCATCCGCTACATCATCGGGATTGGAAAG
CATTTTCAGACCAAGGAGAGTCAGGAGACCCTCCACAAATTTGCATCAAAACCCGCGAGC
GAGTTTGTGAAAATTCTGGACACATTTGAGAAGCTGAAAGATCTATTCACTGAGCTGCAG
AAGAAGATCTATGTCATTGAGGGCACAAGCAAACAGGACCTGACTTCCTTCAACATGGAG
CTGTCCTCCAGCGGCATCAGTGCTGACCTCAGCAGGGGCCATGCAGTCGTGGGGGCAGTA
GGAGCCAAGGACTGGGCTGGGGCTTTCTTGACCTGAAGGCAGACCTGCAGGATGACACA
TTTATTGGGAATGAACCATTGACACCAGAAGTGAGAGCAGGCTATTTGGGTTACACCGTG
ACCTGGCTGCCCTCCCGGCAAAAGACTTCGTTGCTGGCCTCGGGAGCCCCTCGATACCAG
CACATGGGCCGAGTGCTGCTGTTCCAAGAGCCACAGGGCGGAGGACACTGGAGCCAGGTC
CAGACAATCCATGGGACCCAGATTGGCTCTTATTTCGGTGGGGAGCTGTGTGGCGTCGAC
GTGGACCAAGATGGGGAGACAGAGCTGCTGCTGATTGGTGCCCCACTGTTCTATGGGGAG
CAGAGAGGAGGCCGGGTGTTTATCTACCAGAGAAGACAGTTGGGGTTTGAAGAAGTCTCA
GAGCTGCAGGGGGACCCCGGCTACCCACTCGGGCGGTTTGGAGAAGCCATCACTGCTCTG
ACAGACATCAACGGCGATGGGCTGGTAGACGTGGCTGTGGGGCCCCTCTGGAGGAGCAG
GGGGCTGTGTACATCTTCAATGGGAGGCACGGGGGGCTTAGTCCCCAGCCAAGTCAGCGG
ATAGAAGGGACCCAAGTGCTCTCAGGAATTCAGTGGTTTGGACGCTCCATCCATGGGGTG
AAGGACCTTGAAGGGGATGGCTTGGCAGATGTGGCTGTGGGGGCTGAGAGCCAGATGATC
GTGCTGAGCTCCCGGCCCGTGGTGGATATGGTCACCCTGATGTCCTTCTCTCCAGCTGAG
ATCCAGTGCATGAAGTGGAGTGCTCCTATTCAACCAGTAACAAGATGAAAGAAGGAGTT
AATATCACAATCTGTTTCCAGATCAAGTCTCTCATCCCCCAGTTCCAAGGCCGCCTGGTT
GCCAATCTCACTTACACTCTGCAGCTGGATGGCCACCGGACCAGAAGACGGGGGTTGTTC
CCAGGAGGGAGACATGAACTCAGAAGGAATATAGCTGTCACCACCAGCATGTCATGCACT
GACTTCTCATTTCATTTCCCGGTATGTGTTCAAGACCTCATCTCCCCCATCAATGTTTCC
CTGAATTTCTCTCTTTGGGAGGAGGAAGGGACACCGAGGGACCAAAGGGCGGTAAGAAGA
GATGGCTAGGGATGGTGGGGAGTTTATCAGAGAAATCCATTTGGCAAGAAGAGCCGCCCA
TGGCCGGGCAGCACACTCCTATAATCCCAGCACTTTGGGAGGCTGAAGTGGGTGGATCAC
TTAAGGTCAGGGGTTCAGGACCAGCCTGGCCAACATGGTGAAACCCATCTCTACTAAAA
ATACAAAGATTAGTCGGGTGTGATGGTGCACTTGAGGCCAGGAGTTTGAGACCAGCCTGG
GCAACATAGTGGGACTCCCTTTCTACAAAACATAAAAATTAGTTATTGTGATGGTGCGC
CCCTGTAGTCCCAGCTACTTGGGAGGCTGAGCAGGAGGATCACTTGAGCCAGAGGGTTG
AGGCTGCAGTGAGCTATTGAGCTATGATTGCACCACTGCCCTCCAGCCTAGGCAACAGCA
CGAAACCCTGTCTCTAAAGAAG
```

Figure 49b

```
>TB3460_P8 #SNP 214 R->W OTHER KNOWN SNP 660 I->Y
MKDSCITVMAMALLSGFFFFAPASSYNLDVRGARSFSPPRAGRHFGYRVLQVGNGVIVGA
PGEGNSTGSLYQCQSGTGHCLPVTLBGSNYTSKYLGMTLATDPTDGSILACDPGLSBTCD
QNTYLSGLCYLFRQNLQGPMLQGRPGFQECIKGNVDLVFLFDGSMSLQPDEFQKILDFMK
DVMKKLSNTSYQFAAVQFSTSYKTEFDFSDYVKRKDPDALLKHVKHMLLLTNTFGAINYV
ATEVFREELGARPDATKVLIIITDGEATDSGNIDAAKDIIRYIIGIGKHFQTKESQETLH
KFASKPASEFVKILDTFEKLKDLFTELQKKIYVIEGTSKQDLTSFNMELSSSGISADLSR
GHAVVGAVGAKDWAGGFLDLKADLQDDTFIGNEPLTPEVRAGYLGYTVTWLPSRQKTSLL
ASGAPRYQHMGRVLLFQEPQGGGHWSQVQTIHGTQIGSYFGGELCGVDVDQDGETELLLI
GAPLFYGEQRGGRVPIYQRRQLGFEEVSELQGDPGYPLGRFGEAITALTDINGDGLVDVA
VGAPLEEQGAVYIFNGRHGGLSPQPSQRIEGTQVLSGIQWFGRSIHGVKDLEGDGLADVA
VGAESQMIVLSSRPVVDMVTLMSFSPAEIPVHEVECSYSTSNKMKEGVNITICFQIKSLI
PQFQGRLVANLTYTLQLDGHRTBRRGLFPGGRHELRRNIAVTTSMSCTDFSFHFPVCVQD
LISPINVSLNFSLWEEEGTPRDQRA*VRRDG*
```

Alignment of the Integrin alpha L variant T11 product
T83460_P8 (SEQ ID NO:80) to the wild type protein ITAL_HUMAN
(SEQ ID NO:142)

```
  1 MKDSCITVMAMALLSGFFFFAPASSYNLDVRGARSFSPPRAGRHFGYRVL  50
    ||||||||||||||||||||||||||||||||||||||||||||||||||
  1 MKDSCITVMAMALLSGFFFFAPASSYNLDVRGARSFSPPRAGRHFGYRVL  50

51 QVGNGVIVGAPGEGNSTGSLYQCQSGTGHCLPVTLRGSNYTSKYLGMTLA 100
    ||||||||||||||||||||||||||||||||||||||||||||||||||
 51 QVGNGVIVGAPGEGNSTGSLYQCQSGTGHCLPVTLRGSNYTSKYLGMTLA 100

101 TDPTDGSILACDPGLSRTCDQNTYLSGLCYLFRQNLQGPMLQGRPGFQEC 150
    ||||||||||||||||||||||||||||||||||||||||||||||||||
101 TDPTDGSILACDPGLSRTCDQNTYLSGLCYLFRQNLQGPMLQGRPGFQEC 150

151 IKGNVDLVFLFDGSMSLQPDEFQKILDFMKDVMKKLSNTSYQFAAVQFST 200
    ||||||||||||||||||||||||||||||||||||||||||||||||||
151 IKGNVDLVFLFDGSMSLQPDEFQKILDFMKDVMKKLSNTSYQFAAVQFST 200

201 SYKTEFDFSDYVKRKDPDALLKHVKHMLLLTNTFGAINYVATEVFREELG 250
    ||||||||||||||||||||||||||||||||||||||||||||||||||
201 SYKTEFDFSDYVKRKDPDALLKHVKHMLLLTNTFGAINYVATEVFREELG 250

251 ARPDATKVLIIITDGEATDSGNIDAAKDIIRYIIGIGKHFQTKESQETLH 300
    ||||||||||||||||||||||||||||||||||||||||||||||||||
251 ARPDATKVLIIITDGEATDSGNIDAAKDIIRYIIGIGKHFQTKESQETLH 300

301 KFASKPASEFVKILDTFEKLKDLFTELQKKIYVIEGTSKQDLTSFNMELS 350
    ||||||||||||||||||||||||||||||||||||||||||||||||||
301 KFASKPASEFVKILDTFEKLKDLFTELQKKIYVIEGTSKQDLTSFNMELS 350

351 SSGISADLSRGHAVVGAVGAKDWAGGFLDLKADLQDDTFIGNEPLTPEVR 400
    ||||||||||||||||||||||||||||||||||||||||||||||||||
351 SSGISADLSRGHAVVGAVGAKDWAGGFLDLKADLQDDTFIGNEPLTPEVR 400

401 AGYLGYTVTWLPSRQKTSLLASGAPRYQHMGRVLLFQEPQGGHWSQVQT 450
    ||||||||||||||||||||||||||||||||||||||||||||||||||
401 AGYLGYTVTWLPSRQKTSLLASGAPRYQHMGRVLLFQEPQGGHWSQVQT 450

451 IHGTQIGSYFGGELCGVDVDQDGETELLLIGAPLFYGEQRGGRVFIYQRR 500
    ||||||||||||||||||||||||||||||||||||||||||||||||||
451 IHGTQIGSYFGGELCGVDVDQDGETELLLIGAPLFYGEQRGGRVFIYQRR 500

501 QLGFEEVSELQGDPGYPLGRFGEAITALTDINGDGLVDVAVGAPLEEQGA 550
    ||||||||||||||||||||||||||||||||||||||||||||||||||
501 QLGFEEVSELQGDPGYPLGRFGEAITALTDINGDGLVDVAVGAPLEEQGA 550

551 VYIFNGRHGGLSPQPSQRIEGTQVLSGIQWFGRSIHGVKDLEGDGLADVA 600
    ||||||||||||||||||||||||||||||||||||||||||||||||||
551 VYIFNGRHGGLSPQPSQRIEGTQVLSGIQWFGRSIHGVKDLEGDGLADVA 600

601 VGAESQMIVLSSRPVVDMVTLMSFSPAEIPVHEVECSYSTSNKMKEGVNI 650
    ||||||||||||||||||||||||||||||||||||||||||||||||||
601 VGAESQMIVLSSRPVVDMVTLMSFSPAEIPVHEVECSYSTSNKMKEGVNI 650

651 TICFQIKSLIPQFQGRLVANLTYTLQLDGHRTRRRGLFPGGRHELR 696
    |||||||||+||||||||||||||||||||||||||||||||||||
651 TICFQIKSLYPQFQGRLVANLTYTLQLDGHRTRRRGLFPGGRHELR 696
```

```
697 RNIAVTTSMSCTDFSFHFPVCVQDLISPINVSLNFSLWEEEGTPRDQRAV 746
    ||||||||||||||||||||||||||||||||||||||||||||||||
697 RNIAVTTSMSCTDFSFHFPVCVQDLISPINVSLNFSLWEEEGTPRDQRA. 745

747 RRDG                                              750

745 ....                                              745
```

Binnerts et al., 1996

\>HUMGPIIBA_R35 (SEQ ID NO:84)   SNPs locations: 13 T→G; 1079
C→G; 2039 G→C; 3087 C→T NEW EDGE ] [

```
GGCTATAGCCCTTTGCTCTGCCCGTTGCTCAGCAAGTTACTTGGGGTTCCAGTTTGATAA
GAAAAGACTTCCTGTGGAGGAATCTGAAGGGAAGGAGGAGGAGCTGGCCCATTCCTGCCT
GGGAGGTTGTGGAAGAAGGAAGATGGCCAGAGCTTTGTGTCCACTGCAAGCCCTCTGGCT
TCTGGAGTGGGTGCTGCTGCTCTTGGGACCTTGTGCTGCCCCTCCAGCCTGGGCCTTGAA
CCTGGACCCAGTGCAGCTCACCTTCTATGCAGGCCCCAATGGCAGCCAGTTTGGATTTTC
ACTGGACTTCCACAAGGACAGCCATGGGAGAGTGGCCATCGTGGTGGGCGCCCCGCGGAC
CCTGGGCCCCAGCCAGGAGGAGACGGGCGGCGTGTTCCTGTGCCCCTGGAGGGCCGAGGG
CGGCCAGTGCCCCTCGCTGCTCTTTGACCTCCGTGATGAGACCCGAAATGTAGGCTCCCA
AACTTTACAAACCTTCAAGGCCCGCCAAGGACTGGGGGCGTCGGTCGTCAGCTGGAGCGA
CGTCATTGTGGCCTGCGCCCCTGGCAGCACTGGAACGTCCTAGAAAAGACTGAGGAGGC
TGAGAAGACGCCCGTAGGTAGCTGCTTTTTGGCTCAGCCAGAGAGCGGCCGCCGCGCCGA
GTACTCCCCCTGTCGCGGGAACACCCTGAGCCGCATTTACGTGGAAAATGATTTTAGCTG
GGACAAGCGTTACTGTGAAGCGGGCTTCAGCTCCGTGGTCACTCAGGCCGGAGAGCTGGT
GCTTGGGGCTCCTGGCGGCTATTATTTCTTAGGTCTCCTGGCCCAGGCTCCAGTTGCGGA
TATTTTCTCGAGTTACCGCCCAGGCATCCTTTTGTGGCACGTGTCCTCCCAGAGCCTCTC
CTTTGACTCCAGCAACCCAGAGTACTTCGACGGCTACTGGGGGTACTCGGTGGCCGTGGG
CGAGTTCGACGGGGATCTCAACACTACAGAATATGTCGTCGGTGCCCCCACTTGGAGCTG
GACCCTGGGAGCGGTGGAAATTTTGGATTCCTACTACCAGAGGCTGCATCGGCTGCGCGC
AGAGCAGATGGCGTCGTATTTTGGGCATTCAGTGGCTGTCACTGACGTCAACGGGGATGG
GAGGCATGATCTGCTGGTGGGCGCTCCACTGTATATGGAGAGCCGGGCAGACCGAAAACT
GGCCGAAGTGGGGCGTGTGTATTTGTTCCTGCAGCCGCGAGGCCCCCACGCGCTGGGTGC
CCCCAGCCTCCTGCTGACTGGCACACAGCTCTATGGGCGATTCGGCTCTGCCATCGCACC
CCTGGGCGACCTCGACCGGGATGGCTACAATGACATTGCAGTGGCTGCCCCCTACGGGGG
TCCCAGTGGCCGGGGCCAAGTGCTGGTGTTCCTGGGTCAGAGTGAGGGGCTGAGGTCACG
TCCCTCCCAGGTCCTGGACAGCCCCTTCCCCACAGGCTCTGCCTTTGGCTTCTCCCTTCG
AGGTGCCGTAGACATCGATGACAACGGATACCCAGACCTGATCGTGGGAGCTTACGGGGC
CAACCAGGTGGCTGTGTACAGAGCTCAGCCAGTGGTGAAGGCCTCTGTCCAGCTACTGGT
GCAAGATTCACTGAATCCTGCTGTGAAGAGCTGTGTCCTACCTCAGACCAAGACACCCGT
GAGCTGCTTCAACATCCAGATGTGTGTTGGAGCCACTGGGCACAACATTCCTCAGAAGCT
ATCCCTAAATGCCGAGCTGCAGCTGGACCGGCAGAAGCCCCGCCAGGGCCGGCGGGTGCT
GCTGCTGGGCTCTCAACAGGCAGGCACCACCCTGAACCTGGATCTGGGCGGAAAGCACAG
CCCCATCTGCCACACCACCATGGCCTTCCTTCGAGATGAGGCAGACTTCCGGGACAAGCT
GAGCCCCATTGTGCTCAGCCTCAATGTGTCCCTACCGCCCACGGAGGCTGGAATGGCCCC
TGCTGTCGTGCTGCATGGAGACACCCATGTGCAGGAGCAGACACGAATCGTCCTGGACTG
TGGGGAAGATGACGTATGTGTGCCCCAGCTTCAGCTCACTGCCAGCGTGACGGGCTCCCC
GCTCCTAGTTGGGGCAGATAATGTCCTGGAGCTGCAGATGGACGCAGCCAACGAGGGCGA
GGGGGCCTATGAAGCAGAGCTGGCCGTGCACCTGCCCCAGGGCGCCCACTACATGCGGGC
CCTAAGCAATGTCGAGGGCTTTGAGAGACTCATCTGTAATCAGAAGAAGGAGAATGAGAC
CAGGGTGGTGCTGTGTGAGCTGGGCAACCCCATGAAGAAGAACGCCCAGATAGGAATCGC
GATGTTGGTGAGCGTGGGGAATCTGGAAGAGGCTGGGGAGTCTGTGTCCTTCCAGCTGCA
GATACGGAGCAAGAACAGCCAGAATCCAAACAGCAAGATTGTGCTGCTGGACGTGCCGGT
CCGGGCAGAGGCCCAAGTGGAGCTGCGAGGGAACTCCTTTCCAGCCTCCCTGGTGGTGGC
AGCAGAAGAAGGTGAGAGGGAGCAGAACAGCTTGGACAGCTGGGGACCCAAAGTGGAGCA
CACCTATGAGCTCCACAACAATGGCCCTGGGACTGTGAATGGTCTTCACCTCAGCATCCA
CCTTCCGGGACAGTCCCAGCCCTCCGACCTGCTCTACATCCTGGATATACAGCCCCAGGG
GGGCCTTCAGTGCTTCCCACAGCCTCCTGTCAACCCTCTCAAGGTGGACTGGGGCTGCC
CATCCCCAGCCCCTCCCCATTCACCCGGCCCATCACAAGCGGGATCGCAGACAGATCTT
CCTGCCAGAGCCCGAGCAGCCCTCGAGGCTTCAGGATCCAGTTCTCGTAAGCTGCGACTC
GGCGCCCTGTACTGTGGTGCAGTGTGACCTGCAGGAGATGGCGCGCGGGCAGCGGGCCAT
GGTCACGGTGCTGGCCTTCCTGTGGCTGCCCAGCCTCTACCAGAGGCCTCTGGATCAGTT
TGTGCTGCAGTCGCACGCATGGTTCAACGTGTCCTCCCTCCCCTATGCGGTGCCCCCGCT
CAGCCTGCCCCGAGGGGAAGCTC] [AGGTCGGCTTCTTCAAGCGGAACCGGCCACCCCTGGA
AGAAGATGATGAAGAGGGGGAGTGATGGTGCAGCCTACACTATTCTAGCAGGAGGGTTGG
GCGTGCTACCTGCACCGCCCCTTCTCCAACAAGTTGCCTCCAAGCTTTGGGTTGGAGCTG
```

TTCCATTGGGTCCTCTTGGTGTCGTTTCCCTCCCAACAGAGCTGGGCTACCCCCCCTCCT
GCTGCCTAATAAAGAGACTGAGCCCTGAT

Figure 53b

>HUMGPIIBA_X24 (SEQ ID NO: 83)  SNPs locations:313 A→G; 633
C→S; NEW EDGE ] [

MARALCPLQALWLLEWVLLLLGPCAAPPAWALNLDPVQLTFYAGPNGSQFGFSLDFHKDS
HGRVAIVVGAPRTLGPSQEETGGVFLCPWRAEGGQCPSLLFDLRDETRNVGSQTLQTFKA
RQGLGASVVSWSDVIVACAPWQHWNVLEKTEEAEKTPVGSCFLAQPESGRRAEYSPCRGN
TLSRIYVENDFSWDKRYCEAGFSSVVTQAGELVLGAPGGYYFLGLLAQAPVADIFSSYRP
GILLWHVSSQSLSFDSSNPEYFDGYWGYSVAVGEFDGDLNTTEYVVGAPTWSWTLGAVEI
LDSYYQRLHRLRAEQMASYFGHSVAVTDVNGDGRHDLLVGAPLYMESRADRKLAEVGRVY
LFLQPRGPHALGAPSLLLTGTQLYGRFGSAIAPLGDLRDGYNDIAVAAPYGGPSGRGQV
LVFLGQSEGLRSRPSQVLDSPFPTGSAFGFSLRGAVDIDDNGYPDLIVGAYGANQVAVYR
AQPVVKASVQLLVQDSLNPAVKSCVLPQTKTPVSCFNIQMCVGATGHNIPQKLSLNAELQ
LDRQKPRQGRRVLLLGSQQAGTTLNLDLGGKHSPICHTTMAFLRDEADFRDKLSPIVLSL
NVSLPPTEAGMAPAVVLHGDTHVQEQTRIVLDCGEDDVCVPQLQLTASVTGSPLLVGADN
VLELQMDAANEGEGAYEAELAVHLPQGAHYMRALSNVEGFERLICNQKKENETRVVLCEL
GNPMKKNAQIGIAMLVSVGNLEEAGESVSFQLQIRSKNSQNPNSKIVLLDVPVRAEAQVE
LRGNSFPASLVVAAEEGEREQNSLDSWGPKVEHTYELHNNGPGTVNGLHLSIHLPGQSQP
SDLLYILDIQPQGGLQCFPQPPVNPLKVDWGLPIPSPSPIHPAHHKRDRRQIFLPEPEQP
SRLQDPVLVSCDSAPCTVVQCDLQEMARGQRAMVTVLAFLWLPSLYQRPLDQFVLQSHAW
FNVSSLPYAVPPLSLPRGEAQ] [VGFFKRNRPPLEEDDEEGE

Figure 54a

>HUMGPIIBA_R36 (SEQ ID NO: 87) SNPs locations: 13 T→G; 1079 C→G; 2039 G→C; 2745 C→T; NEW EDGE ] [

```
GGCTATAGCCCTTTGCTCTGCCCGTTGCTCAGCAAGTTACTTGGGGTTCCAGTTTGATAA
GAAAAGACTTCCTGTGGAGGAATCTGAAGGGAAGGAGGAGGAGCTGGCCCATTCCTGCCT
GGGAGGTTGTGGAAGAAGGAAGATGGCCAGAGCTTTGTGTCCACTGCAAGCCCTCTGGCT
TCTGGAGTGGGTGCTGCTGCTCTTGGGACCTTGTGCTGCCCCTCCAGCCTGGGCCTTGAA
CCTGGACCCAGTGCAGCTCACCTTCTATGCAGGCCCCAATGGCAGCCAGTTTGGATTTTC
ACTGGACTTCCACAAGGACAGCCATGGGAGAGTGGCCATCGTGGTGGGCGCCCCGCGGAC
CCTGGGCCCCAGCCAGGAGGAGACGGGCGGCGTGTTCCTGTGCCCCTGGAGGGCCGAGGG
CGGCCAGTGCCCCTCGCTGCTCTTTGACCTCCGTGATGAGACCCGAAATGTAGGCTCCCA
AACTTTACAAACCTTCAAGGCCCGCCAAGGACTGGGGCGTCGGTCGTCAGCTGGAGCGA
CGTCATTGTGGCCTGCGCCCCTGGCAGCACTGGAACGTCCTAGAAAAGACTGAGGAGGC
TGAGAAGACGCCCGTAGGTAGCTGCTTTTTGGCTCAGCCAGAGAGCGGCCGCCGCGCCGA
GTACTCCCCCTGTCGCGGGAACACCCTGAGCCGCATTTACGTGGAAAATGATTTTAGCTG
GGACAAGCGTTACTGTGAAGCGGGCTTCAGCTCCGTGGTCACTCAGGCCGGAGAGCTGGT
GCTTGGGGCTCCTGGCGGCTATTATTTCTTAGGTCTCCTGGCCCAGGCTCCAGTTGCGGA
TATTTTCTCGAGTTACCGCCCAGGCATCCTTTTGTGGCACGTGTCCTCCCAGAGCCTCTC
CTTTGACTCCAGCAACCCAGAGTACTTCGACGGCTACTGGGGGTACTCGGTGGCCGTGGG
CGAGTTCGACGGGGATCTCAACACTACAGAATATGTCGTCGGTGCCCCCACTTGGAGCTG
GACCCTGGGAGCGGTGGAAATTTTGGATTCCTACTACCAGAGGCTGCATCGGCTGCGCGC
AGAGCAGATGGCGTCGTATTTTGGGCATTCAGTGGCTGTCACTGACGTCAACGGGGATGG
GAGGCATGATCTGCTGGTGGGCGCTCCACTGTATATGGAGAGCCGGGCAGACCGAAAACT
GGCCGAAGTGGGGCGTGTGTATTTGTTCCTGCAGCCGCGAGGCCCCACGCGCTGGGTGC
CCCCAGCCTCCTGCTGACTGGCACACAGCTCTATGGGCGATTCGGCTCTGCCATCGCACC
CCTGGGCGACCTCGACCGGGATGGCTACAATGACATTGCAGTGGCTGCCCCCTACGGGGG
TCCCAGTGGCCGGGGCCAAGTGCTGGTGTTCCTGGGTCAGAGTGAGGGGCTGAGGTCACG
TCCCTCCCAGGTCCTGGACAGCCCCTTCCCCACAGGCTCTGCCTTTGGCTTCTCCCTTCG
AGGTGCCGTAGACATCGATGACAACGGATACCCAGACCTGATCGTGGGAGCTTACGGGGC
CAACCAGGTGGCTGTGTACAGAGCTCAGCCAGTGGTGAAGGCCTCTGTCCAGCTACTGGT
GCAAGATTCACTGAATCCTGCTGTGAAGAGCTGTGTCCTACCTCAGACCAAGACACCCGT
GAGCTGCTTCAACATCCAGATGTGTGTTGGAGCCACTGGGCACAACATTCCTCAGAAGCT
ATCCCTAAATGCCGAGCTGCAGCTGGACCGGCAGAAGCCCCGCCAGGGCCGGCGGGTGCT
GCTGCTGGGCTCTCAACAGGCAGGCACCACCCTGAACCTGGATCTGGGCGGAAAGCACAG
CCCCATCTGCCACACCACCATGGCCTTCCTTCGAGATGAGGCAGACTTCCGGGACAAGCT
GAGCCCCATTGTGCTCAGCCTCAATGTGTCCCTACCGCCCACGGAGGCTGGAATGGCCCC
TGCTGTCGTGCTGCATGGAGACACCCATGTGCAGGAGCAGACACGAATCGTCCTGGACTG
TGGGGAAGATGACGTATGTGTGCCCCAGCTTCAGCTCACTGCCAGCGTGACGGGCTCCCC
GCTCCTAGTTGGGGCAGATAATGTCCTGGAGCTGCAGATGGACGCAGCCAACGAGGGCGA
GGGGGCCTATGAAGCAGAGCTGGCCGTGCACCTGCCCCAGGGCGCCCACTACATGCGGGC
CCTAAGCAATGTCGAGGGCTTTGAGAGACTCATCTGTAATCAGAAGAAGGAGAATGAGAC
CAGGGTGGTGCTGTGTGAGCTGGGCAACCCCATGAAGAAGAACGCCCAGATAGGAATCGC
GATGTTGGTGAGCGTGGGGAATCTGGAAGAGGCTGGGGAGTCTGTGTCCTTCCAGCTGCA
GATACGGAGCAAGAACAGCCAGAATCCAAACAGCAAGATTGTGCTGCTGGACGTGCCGGT
CCGGGCAGAGGCCCAAGTGGAGCTGCGAGGGAACTCCTTTCCAGCCTCCCTGGTGGTGGC
AGCAGAAGAAGGTGAGAGGGAGCAGAACAGCTTGGACAGCTGGGGACCCAAAGTGGAGCA
CACCTATGAGCTCCACAACAATGGCCCTGGGACTGTGAATGGTCTTCACCTCAGCATCCA
CCTTCCGGGACAGTCCCAGCCCTCCGACCTGCTCTACATCCTGGATATACAGCCCCAGGG
GGGCCTTCAGTGCTTCCCACAGCCTCCTGTCAACCCTCTC] [AAGGTCGGCTTCTTCAAGCG
GAACCGGCCACCCCTGGAAGAAGATGATGAAGAGGGGGAGTGATGGTGCAGCCTACACTA
TTCTAGCAGGAGGGTTGGGCGTGCTACCTGCACCGCCCCTTCTCCAACAAGTTGCCTCCA
AGCTTTGGGTTGGAGCTGTTCCATTGGGTCCTCTTGGTGTCGTTTCCCTCCCAACAGAGC
TGGGCTACCCCCCCTCCTGCTGCCTAATAAAGAGACTGAGCCCTGAT
```

Figure 54b

>HUMGPIIBA_X26 (SEQ ID NO: 86) SNPs locations: 313 A→G; 633
C→S; NEW EDGE ][

MARALCPLQALWLLEWVLLLLGPCAAPPAWALNLDPVQLTFYAGPNGSQFGFSLDFHKDS
HGRVAIVVGAPRTLGPSQEETGGVFLCPWRAEGGQCPSLLFDLRDETRNVGSQTLQTFKA
RQGLGASVVSWSDVIVACAPWQHWNVLEKTEEAEKTPVGSCFLAQPESGRRAEYSPCRGN
TLSRIYVENDFSWDKRYCEAGFSSVVTQAGELVLGAPGGYYFLGLLAQAPVADIFSSYRP
GILLWHVSSQSLSFDSSNPEYFDGYWGYSVAVGEFDGDLNTTEYVVGAPTWSWTLGAVEI
LDSYYQRLHRLRAEQMASYFGHSVAVTDVNGDGRHDLLVGAPLYMESRADRKLAEVGRVY
LFLQPRGPHALGAPSLLLTGTQLYGRFGSAIAPLGDLDRDGYNDIAVAAPYGGPSGRGQV
LVFLGQSEGLRSRPSQVLDSPFPTGSAFGFSLRGAVDIDDNGYPDLIVGAYGANQVAVYR
AQPVVKASVQLLVQDSLNPAVKSCVLPQTKTPVSCFNIQMCVGATGHNIPQKLSLNAELQ
LDRQKPRQGRRVLLLGSQQAGTTLNLDLGGKHSPICHTTMAFLRDEADFRDKLSPIVLSL
NVSLPPTEAGMAPAVVLHGDTHVQEQTRIVLDCGEDDVCVPQLQLTASVTGSPLLVGADN
VLELQMDAANEGEGAYEAELAVHLPQGAHYMRALSNVEGFERLICNQKKENETRVVLCEL
GNPMKKNAQIGIAMLVSVGNLEEAGESVSFQLQIRSKNSQNPNSKIVLLDVPVRAEAQVE
LRGNSFPASLVVAAEEGEREQNSLDSWGPKVEHTYELHNNGPGTVNGLHLSIHLPGQSQP
SDLLYILDIQPQGGLQCFPQPPVNPL][KVGFFKRNRPPLEEDDEEGE

Alignment of Integrin alpha IIb variant T9 HUMGPIIBA_X24 (SEQ ID NO: 83) to the wild type protein ITAB_HUMAN (SEQ ID NO:143)

```
  1 MARALCPLQALWLLEWVLLLLGPCAAPPAWALNLDPVQLTFYAGPNGSQF  50
    ||||||||||||||||||||||||||||||||||||||||||||||||||
  1 MARALCPLQALWLLEWVLLLLGPCAAPPAWALNLDPVQLTFYAGPNGSQF  50

51 GFSLDFHKDSHGRVAIVVGAPRTLGPSQEETGGVFLCPWRAEGGQCPSLL 100
    ||||||||||||||||||||||||||||||||||||||||||||||||||
 51 GFSLDFHKDSHGRVAIVVGAPRTLGPSQEETGGVFLCPWRAEGGQCPSLL 100

101 FDLRDETRNVGSQTLQTFKARQGLGASVVSWSDVIVACAPWQHWNVLEKT 150
    ||||||||||||||||||||||||||||||||||||||||||||||||||
101 FDLRDETRNVGSQTLQTFKARQGLGASVVSWSDVIVACAPWQHWNVLEKT 150

151 EEAEKTPVGSCFLAQPESGRRAEYSPCRGNTLSRIYVENDFSWDKRYCEA 200
    ||||||||||||||||||||||||||||||||||||||||||||||||||
151 EEAEKTPVGSCFLAQPESGRRAEYSPCRGNTLSRIYVENDFSWDKRYCEA 200

201 GFSSVVTQAGELVLGAPGGYYFLGLLAQAPVADIFSSYRPGILLWHVSSQ 250
    ||||||||||||||||||||||||||||||||||||||||||||||||||
201 GFSSVVTQAGELVLGAPGGYYFLGLLAQAPVADIFSSYRPGILLWHVSSQ 250

251 SLSFDSSNPEYFDGYWGYSVAVGEFDGDLNTTEYVVGAPTWSWTLGAVEI 300
    ||||||||||||||||||||||||||||||||||||||||||||||||||
251 SLSFDSSNPEYFDGYWGYSVAVGEFDGDLNTTEYVVGAPTWSWTLGAVEI 300

301 LDSYYQRLHRLRAEQMASYFGHSVAVTDVNGDGRHDLLVGAPLYMESRAD 350
    ||||||||||||||||||||||||||||||||||||||||||||||||||
301 LDSYYQRLHRLRAEQMASYFGHSVAVTDVNGDGRHDLLVGAPLYMESRAD 350

351 RKLAEVGRVYLFLQPRGPHALGAPSLLLTGTQLYGRFGSAIAPLGDLDRD 400
    ||||||||||||||||||||||||||||||||||||||||||||||||||
351 RKLAEVGRVYLFLQPRGPHALGAPSLLLTGTQLYGRFGSAIAPLGDLDRD 400

401 GYNDIAVAAPYGGPSGRGQVLVFLGQSEGLRSRPSQVLDSPFPTGSAFGF 450
    ||||||||||||||||||||||||||||||||||||||||||||||||||
401 GYNDIAVAAPYGGPSGRGQVLVFLGQSEGLRSRPSQVLDSPFPTGSAFGF 450

451 SLRGAVDIDDNGYPDLIVGAYGANQVAVYRAQPVVKASVQLLVQDSLNPA 500
    ||||||||||||||||||||||||||||||||||||||||||||||||||
451 SLRGAVDIDDNGYPDLIVGAYGANQVAVYRAQPVVKASVQLLVQDSLNPA 500

501 VKSCVLPQTKTPVSCFNIQMCVGATGHNIPQKLSLNAELQLDRQKPRQGR 550
    ||||||||||||||||||||||||||||||||||||||||||||||||||
501 VKSCVLPQTKTPVSCFNIQMCVGATGHNIPQKLSLNAELQLDRQKPRQGR 550

551 RVLLLGSQQAGTTLNLDLGGKHSPICHTTMAFLRDEADFRDKLSPIVLSL 600
    ||||||||||||||||||||||||||||||||||||||||||||||||||
551 RVLLLGSQQAGTTLNLDLGGKHSPICHTTMAFLRDEADFRDKLSPIVLSL 600

601 NVSLPPTEAGMAPAVVLHGDTHVQEQTRIVLDCGEDDVCVPQLQLTASVT 650
    ||||||||||||||||||||||||||||||| ||||||||||||||||||
601 NVSLPPTEAGMAPAVVLHGDTHVQEQTRIVLDSGEDDVCVPQLQLTASVT 650
```

```
651  GSPLLVGADNVLELQMDAANEGEGAYEAELAVHLPQGAHYMRALSNVEGF  700
     ||||||||||||||||||||||||||||||||||||||||||||||||||
651  GSPLLVGADNVLELQMDAANEGEGAYEAELAVHLPQGAHYMRALSNVEGF  700

701  ERLICNQKKENETRVVLCELGNPMKKNAQIGIAMLVSVGNLEEAGESVSF  750
     ||||||||||||||||||||||||||||||||||||||||||||||||||
701  ERLICNQKKENETRVVLCELGNPMKKNAQIGIAMLVSVGNLEEAGESVSF  750

751  QLQIRSKNSQNPNSKIVLLDVPVRAEAQVELRGNSFPASLVVAAEEGERE  800
     ||||||||||||||||||||||||||||||||||||||||||||||||||
751  QLQIRSKNSQNPNSKIVLLDVPVRAEAQVELRGNSFPASLVVAAEEGERE  800

801  QNSLDSWGPKVEHTYELHNNGPGTVNGLHLSIHLPGQSQPSDLLYILDIQ  850
     ||||||||||||||||||||||||||||||||||||||||||||||||||
801  QNSLDSWGPKVEHTYELHNNGPGTVNGLHLSIHLPGQSQPSDLLYILDIQ  850

851  PQGGLQCFPQPPVNPLKVDWGLPIPSPSPIHPAHHKRDRRQIFLPEPEQP  900
     ||||||||||||||||||||||||||||||||||||||||||||||||||
851  PQGGLQCFPQPPVNPLKVDWGLPIPSPSPIHPAHHKRDRRQIFLPEPEQP  900

901  SRLQDPVLVSCDSAPCTVVQCDLQEMARGQRAMVTVLAFLWLPSLYQRPL  950
     ||||||||||||||||||||||||||||||||||||||||||||||||||
901  SRLQDPVLVSCDSAPCTVVQCDLQEMARGQRAMVTVLAFLWLPSLYQRPL  950

951  DQFVLQSHAWFNVSSLPYAVPPLSLPRGEAQ..................  981
     |||||||||||||||||||||||||||||||
951  DQFVLQSHAWFNVSSLPYAVPPLSLPRGEAQVWTQLLRALEERAIPIWVV 1000

982  ....................VGFFKRNRPPLEEDDEEGE           1000
                         |||||||||||||||||||
1001 LVGVLGGLLLLTILVLAMWKVGFFKRNRPPLEEDDEEGE           1039
```

Alignment of Integrin alpha IIb variant T8 HUMGPIIBA_X26 (SEQ ID NO:86) to the wild type protein ITAB_HUMAN (SEQ ID NO:143)

```
  1 MARALCPLQALWLLEWVLLLLGPCAAPPAWALNLDPVQLTFYAGPNGSQF  50
    ||||||||||||||||||||||||||||||||||||||||||||||||||
  1 MARALCPLQALWLLEWVLLLLGPCAAPPAWALNLDPVQLTFYAGPNGSQF  50

51 GFSLDFHKDSHGRVAIVVGAPRTLGPSQEETGGVFLCPWRAEGGQCPSLL 100
    ||||||||||||||||||||||||||||||||||||||||||||||||||
 51 GFSLDFHKDSHGRVAIVVGAPRTLGPSQEETGGVFLCPWRAEGGQCPSLL 100

101 FDLRDETRNVGSQTLQTFKARQGLGASVVSWSDVIVACAPWQHWNVLEKT 150
    ||||||||||||||||||||||||||||||||||||||||||||||||||
101 FDLRDETRNVGSQTLQTFKARQGLGASVVSWSDVIVACAPWQHWNVLEKT 150

151 EEAEKTPVGSCFLAQPESGRRAEYSPCRGNTLSRIYVENDFSWDKRYCEA 200
    ||||||||||||||||||||||||||||||||||||||||||||||||||
151 EEAEKTPVGSCFLAQPESGRRAEYSPCRGNTLSRIYVENDFSWDKRYCEA 200

201 GFSSVVTQAGELVLGAPGGYYFLGLLAQAPVADIFSSYRPGILLWHVSSQ 250
    ||||||||||||||||||||||||||||||||||||||||||||||||||
201 GFSSVVTQAGELVLGAPGGYYFLGLLAQAPVADIFSSYRPGILLWHVSSQ 250

251 SLSFDSSNPEYFDGYWGYSVAVGEFDGDLNTTEYVVGAPTWSWTLGAVEI 300
    ||||||||||||||||||||||||||||||||||||||||||||||||||
251 SLSFDSSNPEYFDGYWGYSVAVGEFDGDLNTTEYVVGAPTWSWTLGAVEI 300

301 LDSYYQRLHRLRAEQMASYFGHSVAVTDVNGDGRHDLLVGAPLYMESRAD 350
    ||||||||||||||||||||||||||||||||||||||||||||||||||
301 LDSYYQRLHRLRAEQMASYFGHSVAVTDVNGDGRHDLLVGAPLYMESRAD 350

351 RKLAEVGRVYLFLQPRGPHALGAPSLLLTGTQLYGRFGSAIAPLGDLDRD 400
    ||||||||||||||||||||||||||||||||||||||||||||||||||
351 RKLAEVGRVYLFLQPRGPHALGAPSLLLTGTQLYGRFGSAIAPLGDLDRD 400

401 GYNDIAVAAPYGGPSGRGQVLVFLGQSEGLRSRPSQVLDSPFPTGSAFGF 450
    ||||||||||||||||||||||||||||||||||||||||||||||||||
401 GYNDIAVAAPYGGPSGRGQVLVFLGQSEGLRSRPSQVLDSPFPTGSAFGF 450

451 SLRGAVDIDDNGYPDLIVGAYGANQVAVYRAQPVVKASVQLLVQDSLNPA 500
    ||||||||||||||||||||||||||||||||||||||||||||||||||
451 SLRGAVDIDDNGYPDLIVGAYGANQVAVYRAQPVVKASVQLLVQDSLNPA 500

501 VKSCVLPQTKTPVSCFNIQMCVGATGHNIPQKLSLNAELQLDRQKPRQGR 550
    ||||||||||||||||||||||||||||||||||||||||||||||||||
501 VKSCVLPQTKTPVSCFNIQMCVGATGHNIPQKLSLNAELQLDRQKPRQGR 550

551 RVLLLGSQQAGTTLNLDLGGKHSPICHTTMAFLRDEADFRDKLSPIVLSL 600
    ||||||||||||||||||||||||||||||||||||||||||||||||||
551 RVLLLGSQQAGTTLNLDLGGKHSPICHTTMAFLRDEADFRDKLSPIVLSL 600

601 NVSLPPTEAGMAPAVVLHGDTHVQEQTRIVLDCGEDDVCVPQLQLTASVT 650
    |||||||||||||||||||||||||||||||| |||||||||||||||||
601 NVSLPPTEAGMAPAVVLHGDTHVQEQTRIVLDSGEDDVCVPQLQLTASVT 650

651 GSPLLVGADNVLELQMDAANEGEGAYEAELAVHLPQGAHYMRALSNVEGF 700
    ||||||||||||||||||||||||||||||||||||||||||||||||||
651 GSPLLVGADNVLELQMDAANEGEGAYEAELAVHLPQGAHYMRALSNVEGF 700
```

```
701  ERLICNQKKENETRVVLCELGNPMKKNAQIGIAMLVSVGNLEEAGESVSF  750
     ||||||||||||||||||||||||||||||||||||||||||||||||||
701  ERLICNQKKENETRVVLCELGNPMKKNAQIGIAMLVSVGNLEEAGESVSF  750

751  QLQIRSKNSQNPNSKIVLLDVPVRAEAQVELRGNSFPASLVVAAEEGERE  800
     ||||||||||||||||||||||||||||||||||||||||||||||||||
751  QLQIRSKNSQNPNSKIVLLDVPVRAEAQVELRGNSFPASLVVAAEEGERE  800

801  QNSLDSWGPKVEHTYELHNNGPGTVNGLHLSIHLPGQSPSDLLYILDIQ   850
     ||||||||||||||||||||||||||||||||||||||||||||||||||
801  QNSLDSWGPKVEHTYELHNNGPGTVNGLHLSIHLPGQSPSDLLYILDIQ   850

851  PQGGLQCFPQPPVNPL................................  866
     ||||||||||||||||
851  PQGGLQCFPQPPVNPLKVDWGLPIPSPSPIHPAHHKRDRRQIFLPEPEQP  900

866  .................................................  866

901  SRLQDPVLVSCDSAPCTVVQCDLQEMARGQRAMVTVLAFLWLPSLYQRPL  950

866  .................................................  866

951  DQFVLQSHAWFNVSSLPYAVPPLSLPRGEAQVWTQLLRALEERAIPIWWV  1000

867  ....................KVGFFKRNRPPLEEDDEEGE            886
                         ||||||||||||||||||||
1001 LVGVLGGLLLLTILVLAMWKVGFFKRNRPPLEEDDEEGE             1039
```

Figure 57a

>S80335_T6 #SNP 496 A=>T
CACTTCCTCCTCTGCCGTCTCCCAGATCAGTACACAAAGGCTGCTGCTGCCGCCAGAGGA
AGGACTGCTCTGCACGCACCTATGTGGAAACTAAAGCCCAGAGAGAAAGTCTGACTTGCC
CCACAGCCAGTGAGTGACTGCAGCAGCACCAGAATCTGGTCTGTTTCCTGTTTGGCTCTT
CTACCACTACGGCTTGGGATCTCGGGCATGGTGGCTTTGCCAATGGTCCTTGTTTTGCTG
CTGGTCCTGAGCAGAGGTGAGAGTGAATTGGACGCCAAGATCCCATCCACAGGGGATGCC
ACAGAATGGCGGAATCCTCACCTGTCCATGCTGGGGTCCTGCCAGCCAGCCCCCTCCTGC
CAGAAGTGCATCCTCTCACACCCCAGCTGTGCATGGTGCAAGCAACTGAACTTCACCGCG
TCGGGAGAGGCGGAGGCGCGGCGCTGCGCCCGACGAGAGGAGCTGCTGGCTCGAGGCTGC
CCGCTGGAGGAGCTGGAGGAGCCCCGCGGCCAGCAGGAGGTGCTGCAGGACCAGCCGCTC
AGCCAGGGCGCCCGCGGAGAGGGTGCCACCCAGCTGGCGCCGCAGCGGGTCCGGGTCACG
CTGCGGCCTGGGGAGCCCCAGCAGCTCCAGGTCCGCTTCCTTCGTGCTGAGGGATACCCG
GTGGACCTGTACTACCTTATGGACCTGAGCTACTCCATGAAGGACGACCTGGAACGCGTG
CGCCAGCTCGGGCACGCTCTGCTGGTCCGGCTGCAGGAAGTCACCCATTCTGTGCGCATT
GGT*GAGCCGAGCGCTGCCTCCCGCCCTGTTAGCCCTTGCCTATTCAACCACTGCCCTAGC*
*CTCTGCCAACATCCTGGACTCACAAGGGCCCCAACTTGCCCTCCCAGTTGTTGACAGGCC*
*TAGCCAGGCCACAGG*

Figure 57b

>S80335_P5 #SNP 97 E=>V
MVALPMVLVLLLVLSRGESELDAKIPSTGDATEWRNPHLSMLGSCQPAPSCQKCILSHPS
CAWCKQLNFTASGEAEARRCARREELLARGCPLEELEEPRGQQEVLQDQPLSQGARGEGA
TQLAPQRVRVTLRPGEPQQLQVRFLRAEGYPVDLYYLMDLSYSMKDDLERVRQLGHALLV
RLQEVTHSVRIG*EPSAASRPVSPCLFNHCPSLCQHPGLTRAPTCPPSC*

Figure 59

Alignment of the Integrin beta7 variant T6 (S80335_P5 - SEQ ID NO:89) to the wild type protein ITB7_HUMAN (SEQ ID NO:144)

```
  1 MVALPMVLVLLLVLSRGESELDAKIPSTGDATEWRNPHLSMLGSCQPAPS  50
    ||||||||||||||||||||||||||||||||||||||||||||||||||
  1 MVALPMVLVLLLVLSRGESELDAKIPSTGDATEWRNPHLSMLGSCQPAPS  50

51 CQKCILSHPSCAWCKQLNFTASGEAEARRCARREELLARGCPLEELEEPR 100
    ||||||||||||||||||||||||||||||||||||||||||||||||||
 51 CQKCILSHPSCAWCKQLNFTASGEAEARRCARREELLARGCPLEELEEPR 100

101 GQQEVLQDQPLSQGARGEGATQLAPQRVRVTLRPGEPQQLQVRFLRAEGY 150
    ||||||||||||||||||||||||||||||||||||||||||||||||||
101 GQQEVLQDQPLSQGARGEGATQLAPQRVRVTLRPGEPQQLQVRFLRAEGY 150

151 PVDLYYLMDLSYSMKDDLERVRQLGHALLVRLQEVTHSVRIGEPSAASRP 200
    ||||||||||||||||||||||||||||||||||||
151 PVDLYYLMDLSYSMKDDLERVRQLGHALLVRLQEVTHSVRIG........ 192

201 VSPCLFNHCPSLCQHPGLTRAPTCPPSC                       228

```
>Z40355_T1 #LN 4137
GAAGAGGGAGCGAAGGAGGCGGGGACTGCCAAGGCTCCAGCCCGGCCGGGCTCCGAGGCG
AGAGGCTGCATGGAGTGGCCGGCGCGGCTCTGCGGGCTGTGGGCGCTGCTGCTCTGCGCC
GGCGGCGGGGGCGGGGGCGGGGGCGCCGCGCCTACGGAAACTCAGCCACCTGTGACAAAT
TTGAGTGTCTCTGTTGAAAACCTCTGCACAGTAATATGGACATGGAATCCACCCGAGGGA
GCCAGCTCAAATTGTAGTCTATGGTATTTTAGTCATTTTGGCGACAAACAAGATAAGAAA
ATAGCTCCGGAAACTCGTCGTTCAATAGAAGTACCCCTGAATGAGAGGATTTGTCTGCAA
GTGGGGTCCCAGTGTAGCACCAATGAGAGTGAGAAGCCTAGCATTTTGGTTGAAAAATGC
ATCTCACCCCCAGAAGGTGATCCTGAGTCTGCTGTGACTGAGCTTCAATGCATTTGGCAC
AACCTGAGCTACATGAAGTGTTCTTGGCTCCCTGGAAGGAATACCAGTCCCGACACTAAC
TATACTCTCTACTATTGGCACAGAAGCCTGGAAAAAATTCATCAATGTGAAAACATCTTT
AGAGAAGGCCAATACTTTGGTTGTTCCTTTGATCTGACCAAAGTGAAGGATTCCAGTTTT
GAACAACACAGTGTCCAAATAATGGTCAAGGATAATGCAGGAAAAATTAAACCATCCTTC
AATATAGTGCCTTTAACTTCCCGT***GGTCCAACCTCTCCATACTGCCACATTGGGGATGAA***
*GTTTCAACATGAGTTTGGGAGAAGATAAACATTCAAATCATAGCAGGAACCCAGGCCATC*
*TGACTCTAA*GTGAAACCTGATCCTCCACATATTAAAAACCTCTCCTTCCACAATGATGAC
CTATATGTGCAATGGGAGAATCCACAGAATTTTATTAGCAGATGCCTATTTTATGAAGTA
GAAGTCAATAACAGCCAAACTGAGACACATAATGTTTTCTACGTCCAAGAGGCTAAATGT
GAGAATCCAGAATTTGAGAGAAATGTGGAGAATACATCTTGTTTCATGGTCCCTGGTGTT
CTTCCTGATACTTTGAACACAGTCAGAATAAGAGTCAAAACAAATAAGTTATGCTATGAG
GATGACAAACTCTGGAGTAATTGGAGCCAAGAAATGAGTATAGGTAAGAAGCGCAATTCC
ACACTCTACATAACCATGTTACTCATTGTTCCAGTCATCGTCGCAGGTGCAATCATAGTA
CTCCTGCTTTACCTAAAAAGGCTCAAGATTATTATATTCCCTCCAATTCCTGATCCTGGC
AAGATTTTTAAAGAAATGTTTGGAGACCAGAATGATGATACTCTGCACTGGAAGAAGTAC
GACATCTATGAGAAGCAAACCAAGGAGGAAACCGACTCTGTAGTGCTGATAGAAAACCTG
AAGAAAGCCTCTCAGTGATGGAGATAATTTATTTTTACCTTCACTGTGACCTTGAGAAGA
TTCTTCCCATTCTCCATTTGTTATCTGGGAACTTATTAAATGGAAACTGAAACTACTGCA
CCATTTAAAAACAGGCAGCTCATAAGAGCCACAGGTCTTTATGTTGAGTCGCGCACCGAA
AAACTAAAAATAATGGGCGCTTTGGAGAAGAGTGTGGAGTCATTCTCATTGAATTATAAA
AGCCAGCAGGCTTCAAACTAGGGGACAAAGCAAAAAGTGATGATAGTGGTGGAGTTAATC
TTATCAAGAGTTGTGACAACTTCCTGAGGGATCTATACTTGCTTTGTGTTCTTTGTGTCA
ACATGAACAAATTTTATTTGTAGGGGAACTCATTTGGGGTGCAAATGCTAATGTCAAACT
TGAGTCACAAAGAACATGTAGAAAACAAAATGGATAAAATCTGATATGTATTGTTTGGGA
TCCTATTGAACCATGTTTGTGGCTATTAAAACTCTTTTAACAGTCTGGGCTGGGTCCGGT
GGCTCACGCCTGTAATCCCAGCAATTTGGGAGTCCGAGGCGGGCGGATCACTCGAGGTCA
GGAGTTCCAGACCAGCCTGACCAAAATGGTGAAACCTCCTCTCTACTAAAACTACAAAAA
TTAACTGGGTGTGGTGGCGCGTGCCTGTAATCCCAGCTACTCGGGAAGCTGAGGCAGGTG
AATTGTTTGAACCTGGGAGGTGGAGGTTGCAGTGAGCAGAGATCACACCACTGCACTCTA
GCCTGGGTGACAGAGCAAGACTCTGTCTAAAAAACAAAACAAAACAAAACAAAACAAAAA
AACCTCTTAATATTCTGGAGTCATCATTCCCTTCGACAGCATTTTCCTCTGCTTTGAAAG
CCCCAGAAATCAGTGTTGGCCATGATGACAACTACAGAAAAACCAGAGGCAGCTTCTTTG
CCAAGACCTTTCAAAGCCATTTTAGGCTGTTAGGGCAGTGGAGGTAGAATGACTCCTTG
GGTATTAGAGTTTCAACCATGAAGTCTCTAACAATGTATTTTCTTCACCTCTGCTACTCA
AGTAGCATTTACTGTGTCTTTGGTTTGTGCTAGGCCCCCGGGTGTGAAGCACAGACCCCT
TCCAGGGGTTTACAGTCTATTTGAGACTCCTCAGTTCTTGCCACTTTTTTTTTTAATCTC
CACCAGTCATTTTTCAGACCTTTTAACTCCTCAATTCCAACACTGATTTCCCCTTTTGCA
TTCTCCCTCCTTCCCTTCCTTGTAGCCTTTTGACTTTCATTGGAAATTAGGATGTAAATC
TGCTCAGGAGACCTGGAGGAGCAGAGGATAATTAGCATCTCAGGTTAAGTGTGAGTAATC
TGAGAAACAATGACTAATTCTTGCATATTTTGTAACTTCCATGTGAGGGTTTTCAGCATT
GATATTTGTGCATTTTCTAAACAGAGATGAGGTGGTATCTTCACGTAGAACATTGGTATT
CGCTTGAGAAAAAAGAATAGTTGAACCTATTTCTCTTTCTTTACAAGATGGGTCCAGGA
TTCCTCTTTTCTCTGCCATAAATGATTAATTAAATAGCTTTTGTGTCTTACATTGGTAGC
CAGCCAGCCAAGGCTCTGTTTATGCTTTTGGGGGCATATATTGGGTTCCATTCTCACCT
ATCCACACAACATATCCGTATATATCCCTCTACTCTTACTTCCCCCAAATTTAAAGAAG
TATGGGAAATGAGAGGCATTTCCCCCACCCCATTTCTCTCCTCACACACAGACTCATATT
```

```
ACTGGTAGGAACTTGAGAACTTTATTTCCAAGTTGTTCAAACATTTACCAATCATATTAA
TACAATGATGCTATTTGCAATTCCTGCTCCTAGGGGAGGGGAGATAAGAAACCCTCACTC
TCTACAGGTTGGGTACAAGTGGCAACCTGCTTCCATGGCCGTGTAGAAGCATGGTGCCC
TGGCTTCTCTGAGGAAGCTGGGGTTCATGACAATGGCAGATGTAAAGTTATTCTTGAAGT
CAGATTGAGGCTGGGAGACAGCCGTAGTAGATGTTCTACTTTGTTCTGCTGTTCTCTAGA
AAGAATATTTGGTTTTCCTGTATAGGAATGAGATTAATTCCTTTCCAGGTATTTTATAAT
TCTGGGAAGCAAAACCCATGCCTCCCCCTAGCCATTTTTACTGTTATCCTATTTAGATGG
CCATGAAGAGGATGCTGTGAAATTCCCAACAAACATTGATGCTGACAGTCATGCAGTCTG
GGAGTGGGGAAGTGATCTTTTGTTCCCATCCTCTTCTTTTAGCAGTAAAATAGCTGAGGG
AAAAGGGAGGGAAAAGGAAGTTATGGGAATACCTGTGGTGGTTGTGATCCCTAGGTCTTG
GGAGCTCTTGGAGGTGTCTGTATCAGTGGATTTCCCATCCCCTGTGGGAAATTAGTAGGC
TCATTACTGTTTTAGGTCTAGCCTATGTGGATTTTTTCCTAACATACCTAAGCAAACCC
AGTGTCAGGATGGTAATTCTTATTCTTTCGTTCAGTTAAGTTTTTCCCTTCATCTGGGCA
CTGAAGGGATATGTGAAACAATGTTAACATTTTTGGTAGTCTTCAACCAGGGATTGTTTC
TGTTAACTTCTTATAGGAAAGCTTGAGTAAAATAAATATTGTCTTTTGTATGTCA
```

Figure 61b

```
>Z40355_P2
MEWPARLCGLWALLLCAGGGGGGGAAPTETQPPVTNLSVSVENLCTVIWTWNPPEGASS
NCSLWYFSHFGDKQDKKIAPETRRSIEVPLNERICLQVGSQCSTNESEKPSILVEKCISP
PEGDPESAVTELQCIWHNLSYMKCSWLPGRNTSPDTNYTLYYWHRSLEKIHQCENIFREG
QYFGCSFDLTKVKDSSFEQRSVQIMVKDNAGKIKPSFNIVPLTSR*GFTSPYCHIGDEVST*
```

Figure 63

Alignment of the Interleukin 13 receptor alpha 1 variant T1 to Z40355_P2 (SEQ ID NO: 92) the wild type protein (SEQ ID NO:145)

```
  1 MEWPARLCGLWALLLCAGGGGGGGAAPTETQPPVTNLSVSVENLCTVIW  50
    |||||||||||||||||||||||||||||||||||||||||||||||||
  1 MEWPARLCGLWALLLCAGGGGGGGAAPTETQPPVTNLSVSVENLCTVIW  50

51 TWNPPEGASSNCSLWYFSHFGDKQDKKIAPETRRSIEVPLNERICLQVGS 100
    |||||||||||||||||||||||||||||||||||||||||||||||||
 51 TWNPPEGASSNCSLWYFSHFGDKQDKKIAPETRRSIEVPLNERICLQVGS 100

101 QCSTNESEKPSILVEKCISPPEGDPESAVTELQCIWHNLSYMKCSWLPGR 150
    |||||||||||||||||||||||||||||||||||||||||||||||||
101 QCSTNESEKPSILVEKCISPPEGDPESAVTELQCIWHNLSYMKCSWLPGR 150

151 NTSPDTNYTLYYWHRSLEKIHQCENIFREGQYFGCSFDLTKVKDSSFEQH 200
    |||||||||||||||||||||||||||||||||||||||||||||||||
151 NTSPDTNYTLYYWHRSLEKIHQCENIFREGQYFGCSFDLTKVKDSSFEQH 200

201 SVQIMVKDNAGKIKPSFNIVPLTSRGPTSPYCHIGDEVST            240
    ||||||||||||||||||||||||
201 SVQIMVKDNAGKIKPSFNIVPLTSR...............            225
```

Figure 65a

>HUMC1RS_T7 #LN 3003 first unique region is in 5' UTR second in coding

```
ATGCACACTCGGGTAGGGAATCTTATGAACAGAACCAGGACAGGGAGGCTGGCCGGAGGTTCCTGCAGA
GGGAGCGTCAAGGCCCTGTGGTGCTGTCCCTGGGGGCCAGAGGGGTTGCCCAGCATGCCCACTGGCAGG
AGAGAGGGAACTGACCCACTTGCTCCTACCAGCTTCTGAAGGTGACACTGAGCCCCAGGTGACGGCCGCA
CCACCAAAGAAGGTGCTTGTGTTTGTCAGACAAATACAGCCAGGCCTGCCACCCCTTAGGCTCCAAAGT
CCGGAGGTGCAGAAAGCCAGGACCAAGAGACAGGCAGCTCACCAGGGTGGACAAATCGCCAGAGATGTG
GTGCATTGTCCTGTTTTCACTTTTGGCATGGGTTTATGCTGAGCCTACCATGTATGGGGAGATCCTGTC
CCCTAACTATCCTCAGGCATATCCCAGTGAGGTAGAGAAATCTTGGGACATAGAAGTTCCTGAAGGGTA
TGGGATTCACCTCTACTTCACCCATCTGGACATTGAGCTGTCAGAGAACTGTGCGTATGACTCAGTGCA
GATAATCTCAGGAGACACTGAAGAAGGGAGGCTCTGTGGACAGAGGAGCAGTAACAATCCCCACTCTCC
AATTGTGGAAGAGTTCCAAGTCCCATACAACAAACTCCAGGTGATCTTTAAGTCAGACTTTTCCAATGA
AGAGCGTTTTACGGGGTTTGCTGCATACTATGTTGCCACAGACATAAATGAATGCACAGATTTTGTAGA
TGTCCCTTGTGTAGCCACTTCTGCAACAATTTCATTGGTGGTTACTTCTGCTCCTGCCCCCGGAATATTT
CCTCCATGATGACATGAAGAATTGCGGAGTTAATTGCAGTGGGGATGTATTCACTGCACTGATTGGGGA
GATTGCAAGTCCCAATTATCCCAAACCATATCCAGAGAACTCAAGGTGTGAATACCAGATCCGGTTGGA
GAAAGGGTTCCAAGTGGTGGTGACCTTGCGGAGAGAAGATTTTGATGTGGAAGCAGCTGACTCAGCGGG
AAACTGCCTTGACAGTTTAGTTTTTGTTGCAGGAGATCGGCAATTTGGTCCTTACTGTGGTCATGGATT
CCCTGGGCCTCTAAATATTGAAACCAAGAGTAATGCTCTTGATATCATCTTCCAAACTGATCTAACAGG
GCAAAAAAAGGGCTGGAAACTTCGCTATCATGGAGATCCAATGCCCTGCCCTAAGGAAGACACTCCCAA
TTCTGTTTGGGAGCCTGCGAAGGCAAAATATGTCTTTAGAGATGTGGTGCAGATAACCTGTCTGGATGG
GTTTGAAGTTGTGGAGGGACGTGTTGGTGCAACATCTTTCTATTCGACTTGTCAAAGCAATGGAAAGTG
GAGTAATTCCAAACTGAAATGTCAACCTGTGGACTGTGGCATTCCTGAATCCATTGAGAATGGTAAAGT
TGAAGACCCAGAGAGCACTTTGTTTGGTTCTGTCATCCGCTACACTTGTGAGGAGCCATATTACTACAT
GGAAAATGGAGGAGGTGGGGAGTATCACTGTGCTGGTAACGGGAGCTGGGTGAATGAGGTGCTGGGCCC
GGAGCTGCCGAAATGTGTTCCAGGACTGAACAGTGACCTGCCAGAGTCCAGCTCAGTGAGGTGGCAGTA
TCACTGTGCCGTGGCTGCCAGGCCGTGGGGAACCTCCTCAGCCGCACTGAAGCCAGGCCAACTGGAA
GGAAATAGAAACGTCAGCCAGCGACAGTTGGTGTCTGGTAATGTAGCTGCAGTGACAAGATACAGAACT
GCTAAAAACAGGGCCTGAAAGCTGAGAGTGTTCTGTGGAGTCCCCAGAGAACCCTTTGAAGAAAACAG
AGGATAATTGGAGGATCCGATGCAGATATTAAAAACTTCCCTGGCAAGTCTTCTTTGACAACCCATGG
GCTGGTGGAGCGCTCATTAATGAGTACTGGGTGCTGACGGCTGCTCATGTTGTGGAGGGAAACAGGGAG
CCAACAATGTATGTTGGGTCCACCTCAGTGCAGACCTCACGGCTGGCAAAATCCAAGATGCTCACTCCT
GAGCATGTGTTTATTCATCCGGGATGGAAGCTGCTGGAAGTCCCAGAAGGACGAACCAATTTTGATAAT
GACATTGCACTGGTGCGGCTGAAAGACCCAGTGAAAATGGGACCCACCGTCTCTCCCATCTGCCTACCA
GGCACCTCTTCCGACTACAACCTCATGGATGGGGACCTGGGACTGATCTCAGGCTGGGGCCGAACAGAG
AAGAGAGATCGTGCTGTTCGCCTCAAGGCGGCAAGGTTACCTGTAGCTCCTTTAAGAAAATGCAAAGAA
GTGAAAGTGGAGAAACCCACAGCAGATGCAGAGGCCTATGTTTTCACTCCTAACATGATCTGTGCTGGA
GGAGAGAAGGGCATGGATAGCTGTAAAGGGGACAGTGGTGGGGCCTTTGCTGTACAGGATCCCAATGAC
AAGACCAAATTCTACGCAGCTGGCCTGGTGTCCTGGGGGCCCCAGTGTGGGACCTATGGGCTCTACACA
CGGGTAAAGAACTATGTTGACTGGATAATGAAGACTATGCAGGAAAATAGCACCCCCCGTGAGGACTAA
TCCAGATACATCCCACCAGCCTCTCCAAGGGTGGTGACCAATGCATTACCTTCTGTTCCTTATGATATT
CTCATTATTCATCATGACTGAAAGAAGACACGAGCGAATGATTTAAATAGAACTTGATTGTTGAGACG
CCTTGCTAGAGGTAGAGTTTGATCATAGAATTGTGCTGGTCATACATTTGTGGTCTGACTCCTTGGGGT
CCTTTCCCCGGAGTACCTATTGTAGATAACACTATGGGTGGGCACTCCTTTCTTGCACTATTCCACAG
GGATACCTTAATTCTTTGTTCCTCTTTACCTGTTCAAAATTCCATTTACTTGATCATTCTCAGTATCC
ACTGTCTATGTACAATAAAGGATGTTTATAAGCAAA
```

Figure 65b

>HUMC1RS_PROT_OF_TR7

MWCIVLFSLLAWVYAEPTMYGEILSPNYPQAYPSEVEKSWDIEVPEGYGIHLYFTHLDIELSENCAYDS
VQIISGDTEEGRLCGQRSSNNPHSPIVEEFQVPYNKLQVIFKSDFSNEERFTGFAAYYVATDINECTDF
VDVPCSHFCNNFIGGYFCSCPPEYFLHDDMKNCGVNCSGDVFTALIGEIASFNYPKFYPENSRCEYQIR
LEKGFQVVVTLRREDFDVEAADSAGNCLDSLVFVAGDRQFGPYCGHGFPGPLNIETKSNALDIIFQTDL
TSQKKGWKLRYHGDPNPCPKEDTPNSVWEPAKAKYVFRDVVQITCLDGFEVVEGRVGATSFYSTCQSNG
KWSNSKLKCQPVDCGIPESLENGKVEDPESTLFGSVIRYTCEEPYYYMENGGGGEYHCAGNGSWVNEVL
GPELPKCVP*GLNSDLPESSSVRWQYHCAVGCQGRGEPPQPH*

Figure 65c

>HUMC1RS_T8 #LN 2590 first unique region is in 5' UTR second is a new
edge ][

ATGCACACTCGGGTAGGGAATCTTATGAACAGAACCAGGACAGGGAGGCTGGCCGGAGGTTCCTGCAGA
GGGAGCGTCAAGGCCCTGTGCTGCTGTCCCTGGGGGCCAGAGGGGTTGCCCAGCATGCCCACTGGCAGG
AGAGAGGGAACTGACCCACTTGCTCCTACCAGCTTCTGAAG*GTGACACTGAGCCCCAGGTGACGCCGCA*
*CCACCAAAGAAGGTGCTTGTGTTTGTCAGACAAATACAGCCAGGCCTGCCACCCCTT*AGGCTCCAAAGT
CCGGAGGTGCAGAAAGCCAGGACCAAGAGACAGGCAGCTCACCAGGGTGGACAAATCGCCAGAGATGTG
GTGCATTGTCCTGTTTTCACTTTTGGCATGGGTTTATGCTGAGCCTACCATGTATGGGGAGATCCTGTC
CCCTAACTATCCTCAGGCATATCCCAGTGAGGTAGAGAAATCTTGGGACATAGAAGTTCCTGAAGGGTA
TGGGATTCACCTCTACTTCACCCATCTGG] [ACATAAATGAATGCACAGATTTTGTAGATGTCCCTTGT
AGCCACTTCTGCAACAATTTCATTGGTGGTTACTTCTGCTCCTGCCCCCCGGAATATTTCCTCCATGAT
GACATGAAGAATTGCGGAGTTAATTGCAGTGGGGATGTATTCACTGCACTGATTGGGGAGATTGCAAGT
CCCAATTATCCCAAACCATATCCAGAGAACTCAAGGTGTGAATACCAGATCCGGTTGGAGAAAGGGTTC
CAAGTGGTGGTGACCTTGCGGAGAGAAGATTTTGATGTGGAAGCAGCTGACTCAGCGGGAAACTGCCTT
GACAGTTTAGTTTTTGTTGCAGGAGATCGGCAATTTGGTCCTTACTGTGGTCATGGATTCCCTGGGCCT
CTAAATATTGAAACCAAGAGTAATGCTCTTGATATCATCTTCCAAACTGATCTAACAGGGCAAAAAAAG
GGCTGGAAACTTCGCTATCATGGAGATCCAATGCCCTGCCCTAAGGAAGACACTCCCAATTCTGTTTGG
GAGCCTGCCAAGGCAAAATATGTCTTTAGAGATGTGGTGCAGATAACCTGTCTGGATGGGTTTGAAGTT
GTGGAGGGACGTGTTGGTGCAACATCTTTCTATTCGACTTGTCAAAGCAATGGAAAGTGGAGTAATTCC
AAACTGAAATGTCAACCTGTGGACTGTGGCATTCCTGAATCCATTGAGAATGGTAAAGTTGAAGACCCA
GAGAGCACTTTGTTTGGTTCTGTCATCCGCTACACTTGTGAGGAGCCATATTACTACATGGAAAATGGA
GGAGGTGGGGAGTATCACTGTGCTGGTAACGGGAGCTGGGTGAATGAGGTGCTGGGCCCGGAGCTGCCG
AAATGTGTTCCAGTCTGTGGAGTCCCCAGAGAACCCTTTGAAGAAAAACAGAGGATAATTGGAGGATCC
GATGCAGATATTAAAAACTTCCCCTGGCAAGTCTTCTTTGACAACCCATGGGCTGGTGGAGCGCTCATT
AATGAGTACTGGGTGCTGACGGCTGCTCATGTTGTGGAGGGAAACAGGGAGCCAACAATGTATGTTGGG
TCCACCTCAGTGCAGACCTCACGGCTGGCAAAATCCAAGATGCTCACTCCTGAGCATGTGTTTATTCAT
CCGGGATGGAAGCTGCTGGAAGTCCCAGAAGGACGAACCAATTTTGATAATGACATTGCACTGGTGCGG
CTGAAAGACCCAGTGAAAATGGGACCCACCGTCTCTCCCATCTGCCTACCAGGCACCTCTTCCGACTAC
AACCTCATGGATGGGGACCTGGACTGATCTCAGGCTGGGGCCGAACAGAGAAGAGAGATCGTGCTGTT
CGCCTCAAGGCGGCAAGGTTACCTGTAGCTCCTTTAAGAAAATGCAAAGAAGTGAAAGTGGAGAAACCC
ACAGCAGATGCAGAGGCCTATGTTTTCACTCCTAACATGATCTGTGCTGGAGGAGAGAAGGGCATGGAT
AGCTGTAAAGGGGACAGTGGTGGGGCCTTTGCTGTACAGGATCCCAATGACAAGACCAAATTCTACGCA
GCTGGCCTGGTGTCCTGGGGGCCCCAGTGTGGGACCTATGGGCTCTACACACGGGTAAAGAACTATGTT
GACTGGATAATGAAGACTATGCAGGAAAATAGCACCCCCGTGAGGACTAATCCAGATACATCCCACCA
GCCTCTCCAAGGGTGGTGACCAATGCATTACCTTCTGTTCCTTATGATATTCTCATTATTTCATCATGA
CTGAAAGAAGACACGAGCGAATGATTTAAATAGAACTTGATTGTTGAGACGCCTTGCTAGAGGTAGAGT
TTGATCATAGAATTGTGCTGGTCATACATTTGTGGTCTGACTCCTTGGGGTCCTTTCCCCGGAGTACCT
ATTGTAGATAACACTATGGGTGGGGCACTCCTTTCTTGCACTATTCCACAGGGATACCTTAATTCTTTG
TTTCCTCTTTACCTGTTCAAAATTCCATTTACTTGATCATTCTCAGTATCCACTGTCTATGTACAATAA
AGGATGTTTATAAGCAAA

Figure 65d

```
>HUMC1RS_PROT_OF_TR8
MWCIVLFSLLAWVYAEPTMYGEILSPNYPQAYPSEVEKSWDIEVPEGYGIHLYFTHLDIELSEN}Y{IN
ECTDFVDVPCSHFCNNFIGGYFCSCPPEYFLHDDMKNCGVNCSGDVFTALIGEIASPNYPKPYPENSRC
EYQIRLEKGFQVVVTLRREDFDVEAADSAGNCLDSLVPVAGDRQFGPYCGHGFPGPLNIETKSNALDII
FQTDLTGQKRGWKLRYSGDPMPCPKEDTPNSVWEPAKAKYVFRDVVQITCLDGFEVVEGRVGATSFYST
CQSNGKWSNSKLKCQPVDCGIPESIENGKVEDPESTLFGSVIRYTCEEPYYYMENGGGGEYHCAGNGSW
VNEVLGPELPKCVPVCGVPREPFEEKQRIIGGSDADIKNFPWQVFFDNPWAGGALINEYWVLTAAHVVE
GNREPTMYVGSTSVQTSRLAKSKMLTPEHVFIHPGWKLLEVPEGRTNFDNDIALVRLKDPVKMGPTVSP
ICLPGTSSDYNLMDGDLGLISGWGRTEKRDRAVRLKAARLPVAPLRKCKEVKVEKPTADAEAYVFTPNM
ICAGGEKGMDSCKGDSGGAFAVQDPNDKTKFYAAGLVGWGPQCGTYGLYTRVKNYVDWIMKTMQENSTP
RED
```

Figure 67a

Alignment of the Complement component C1s variant T7
(HUMC1RS_P5 - SEQ ID NO:98) to the wild type protein C1S_HUMAN
(SEQ ID NO:146)

```
  1 MWCIVLFSLLAWVYAEPTMYGEILSPNYPQAYPSEVEKSWDIEVPEGYGI  50
    ||||||||||||||||||||||||||||||||||||||||||||||||||
  1 MWCIVLFSLLAWVYAEPTMYGEILSPNYPQAYPSEVEKSWDIEVPEGYGI  50

51 HLYFTHLDIELSENCAYDSVQIISGDTEEGRLCGQRSSNNPHSPIVEEFQ 100
    ||||||||||||||||||||||||||||||||||||||||||||||||||
 51 HLYFTHLDIELSENCAYDSVQIISGDTEEGRLCGQRSSNNPHSPIVEEFQ 100

101 VPYNKLQVIFKSDFSNEERFTGFAAYYVATDINECTDFVDVPCSHFCNNF 150
    ||||||||||||||||||||||||||||||||||||||||||||||||||
101 VPYNKLQVIFKSDFSNEERFTGFAAYYVATDINECTDFVDVPCSHFCNNF 150

151 IGGYFCSCPPEYFLHDDMKNCGVNCSGDVFTALIGEIASPNYPKPYPENS 200
    ||||||||||||||||||||||||||||||||||||||||||||||||||
151 IGGYFCSCPPEYFLHDDMKNCGVNCSGDVFTALIGEIASPNYPKPYPENS 200

201 RCEYQIRLEKGFQVVVTLRREDFDVEAADSAGNCLDSLVFVAGDRQFGPY 250
    ||||||||||||||||||||||||||||||||||||||||||||||||||
201 RCEYQIRLEKGFQVVVTLRREDFDVEAADSAGNCLDSLVFVAGDRQFGPY 250

251 CGHGFPGPLNIETKSNALDIIFQTDLTGQKKGWKLRYHGDPMPCPKEDTP 300
    ||||||||||||||||||||||||||||||||||||||||||||||||||
251 CGHGFPGPLNIETKSNALDIIFQTDLTGQKKGWKLRYHGDPMPCPKEDTP 300

301 NSVWEPAKAKYVFRDVVQITCLDGFEVVEGRVGATSFYSTCQSNGKWSNS 350
    ||||||||||||||||||||||||||||||||||||||||||||||||||
301 NSVWEPAKAKYVFRDVVQITCLDGFEVVEGRVGATSFYSTCQSNGKWSNS 350

351 KLKCQPVDCGIPESIENGKVEDPESTLFGSVIRYTCEEPYYYMENGGGGE 400
    ||||||||||||||||||||||||||||||||||||||||||||||||||
351 KLKCQPVDCGIPESIENGKVEDPESTLFGSVIRYTCEEPYYYMENGGGGE 400

401 YHCAGNGSWVNEVLGPELPKCVPGLNSDLPESSSVRWQYHCAVGCQGRGE 450
    |||||||||||||||||||||||||
401 YHCAGNGSWVNEVLGPELPKCVP........................... 423

451 PPQPH                                              455

Alignment of the Complement component C1s variant T8
(HUMC1RS_P6 - SEQ ID NO:95) to the wild type protein C1S_HUMAN
(SEQ ID NO:146)

```
  1 MWCIVLFSLLAWVYAEPTMYGEILSPNYPQAYPSEVEKSWDIEVPEGYGI  50
    ||||||||||||||||||||||||||||||||||||||||||||||||||
  1 MWCIVLFSLLAWVYAEPTMYGEILSPNYPQAYPSEVEKSWDIEVPEGYGI  50

51 HLYFTHLDIELSENY...................................  64
    |||||||||||||||
 51 HLYFTHLDIELSENCAYDSVQIISGDTEEGRLCGQRSSNNPHSPIVEEFQ 100

65 ........................ .......INECTDFVDVPCSHFCNNF  84
                                    ||||||||||||||||||||
101 VPYNKLQVIFKSDFSNEERFTGFAAYYVATDINECTDFVDVPCSHFCNNF 150

85 IGGYFCSCPPEYFLHDDMKNCGVNCSGDVFTALIGEIASPNYPKPYPENS 134
    ||||||||||||||||||||||||||||||||||||||||||||||||||
151 IGGYFCSCPPEYFLHDDMKNCGVNCSGDVFTALIGEIASPNYPKPYPENS 200

135 RCEYQIRLEKGFQVVVTLRREDFDVEAADSAGNCLDSLVFVAGDRQFGPY 184
    ||||||||||||||||||||||||||||||||||||||||||||||||||
201 RCEYQIRLEKGFQVVVTLRREDFDVEAADSAGNCLDSLVFVAGDRQFGPY 250

185 CGHGFPGPLNIETKSNALDIIFQTDLTGQKKGWKLRYHGDPMPCPKEDTP 234
    ||||||||||||||||||||||||||||||||||||||||||||||||||
251 CGHGFPGPLNIETKSNALDIIFQTDLTGQKKGWKLRYHGDPMPCPKEDTP 300

235 NSVWEPAKAKYVFRDVVQITCLDGFEVVEGRVGATSFYSTCQSNGKWSNS 284
    ||||||||||||||||||||||||||||||||||||||||||||||||||
301 NSVWEPAKAKYVFRDVVQITCLDGFEVVEGRVGATSFYSTCQSNGKWSNS 350

285 KLKCQPVDCGIPESIENGKVEDPESTLFGSVIRYTCEEPYYYMENGGGGE 334
    ||||||||||||||||||||||||||||||||||||||||||||||||||
351 KLKCQPVDCGIPESIENGKVEDPESTLFGSVIRYTCEEPYYYMENGGGGE 400

335 YHCAGNGSWVNEVLGPELPKCVPVCGVPREPFEEKQRIIGGSDADIKNFP 384
    ||||||||||||||||||||||||||||||||||||||||||||||||||
401 YHCAGNGSWVNEVLGPELPKCVPVCGVPREPFEEKQRIIGGSDADIKNFP 450

385 WQVFFDNPWAGGALINEYWVLTAAHVVEGNREPTMYVGSTSVQTSRLAKS 434
    ||||||||||||||||||||||||||||||||||||||||||||||||||
451 WQVFFDNPWAGGALINEYWVLTAAHVVEGNREPTMYVGSTSVQTSRLAKS 500

435 KMLTPEHVFIHPGWKLLEVPEGRTNFDNDIALVRLKDPVKMGPTVSPICL 484
    ||||||||||||||||||||||||||||||||||||||||||||||||||
501 KMLTPEHVFIHPGWKLLEVPEGRTNFDNDIALVRLKDPVKMGPTVSPICL 550

485 PGTSSDYNLMDGDLGLISGWGRTEKRDRAVRLKAARLPVAPLRKCKEVKV 534
    ||||||||||||||||||||||||||||||||||||||||||||||||||
551 PGTSSDYNLMDGDLGLISGWGRTEKRDRAVRLKAARLPVAPLRKCKEVKV 600

535 EKPTADAEAYVFTPNMICAGGEKGMDSCKGDSGGAFAVQDPNDKTKFYAA 584
    ||||||||||||||||||||||||||||||||||||||||||||||||||
601 EKPTADAEAYVFTPNMICAGGEKGMDSCKGDSGGAFAVQDPNDKTKFYAA 650
```

```
585 GLVSWGPQCGTYGLYTRVKNYVDWIMKTMQENSTPRED    622
    ||||||||||||||||||||||||||||||||||||||
651 GLVSWGPQCGTYGLYTRVKNYVDWIMKTMQENSTPRED    688
```

Figure 69a

>HUMC5_P7 #LN 2990 SNP reported in patent 1196 C=>T 2434 G=>A

ATATATCCGTGGTTTCCTGCTACCTCCAACCATGGGCCTTTTGGGAATACTTTGTTTTTTAATCTTCCT
GGGGAAAACCTGGGGACAGGAGCAAACATATGTCATTTCAGCACCAAAAATATTCCGTGTTGGAGCATC
TGAAAATATTGTGATTCAAGTTTATGGATACACTGAAGCATTTGATGCAACAATCTCTATTAAAAGTTA
TCCTGATAAAAAATTTAGTTACTCCTCAGGCCATGTTCATTTATCCTCAGAGAATAAATTCCAAAACTC
TGCAATCTTAACAATACAACCAAAACAATTGCCTGGAGGACAAAACCCAGTTTCTTATGTGTATTTGGA
AGTTGTATCAAAGCATTTTTCAAAATCAAAAAGAATGCCAATAACCTATGACAATGGATTTCTCTTCAT
TCATACAGACAAACCTGTTTATACTCCAGACCAGTCAGTAAAAGTTAGAGTTTATTCGTTGAATGACGA
CTTGAAGCCAGCCAAAAGAGAAACTGTCTTAACTTTCATACATCCTGAAGGATCAGAAGTTGACATGGT
AGAAGAAATTGATCATATTGGAATTATCTCTTTTCCTGACTTCAAGATTCCGTCTAATCCTAGATATGG
TATGTGGACGATCAAGGCTAAATATAAAGAGGACTTTTCAACAACTGGAACCGCATATTTTGAAGTTAA
AGAATATGTCTTGCCACATTTTTCTGTCTCAATCGAGCCAGAATATAATTTCATTGGTTACAAGAACTT
TAAGAATTTTGAAATTACTATAAAAGCAAGATATTTTTATAATAAAGTAGTCACTGAGGCTGACGTTTA
TATCACATTTGGAATAAGAGAAGACTTAAAAGATGATCAAAAAGAAATGATGCAAACAGCAATGCAAAA
CACAATGTTGATAAATGGAATTGCTCAAGTCACATTTGATTCTGAAACAGCAGTCAAAGAACTGTCATA
CTACAGTTTAGAAGATTTAAACAACAAGTACCTTTATATTGCTGTAACAGTCATAGAGTCTACAGGTGG
ATTTTCTGAAGAGGCAGAAATACCTGGCATCAAATATGTCCTCTCTCCCTACAAACTGAATTTGGTTGC
TACTCCTCTTTTCCTGAAGCCTGGGATTCCATATCCCATCAAGGTGCAGGTTAAAGATTCGCTTGACCA
GTTGGTAGGAGGAGTCCCAGTAACACTGAATGCACAAACAATTGATGTAAACCAAGAGACATCTGACTT
GGATCCAAGCAAAAGTGTAACACGTGTTGATGATGGAGTAGCTTCCTTTGTGCTTAATCTCCCATCTGG
AGTGACGGTGCTGGAGTTTAATGTCAAAACTGATGCTCCAGATCTTCCAGAAGAAAATCAGGCCAGGGA
AGGTTACCGAGCAATAGCATACTCATCTCTCAGCCAAAGTTACCTTTATATTGATTGGACTGATAACCA
TAAGGCTTTGCTAGTGGGAGAACATCTGAATATTATTGTTACCCCCAAAAGCCCATATATTGACAAAAT
AACTCACTATAATTACTTGATTTTATCCAAGGGCAAAATTATCCACTTTGGCACGAGGGAGAAATTTTC
AGATGCATCTTATCAAAGTATAAACATTCCAGTAACACAGAACATGGTTCCTTCATCCCGACTTCTGGT
CTATTATATCGTCACAGGAGAACAGACAGCAGAATTAGTGTCTGATTCAGTCTGGTTAAATATTGAAGA
AAAATGTGGCAACCAGCTCCAGGTTCATCTGTCTCCTGATGCAGATGCATATTCTCCAGGCCAAACTGT
GTCTCTTAATATGGCAACTGGAATGGATTCCTGGGTGGCATTAGCAGCAGTGGACAGTGCTGTGTATGG
AGTCCAAAGAGGAGCCAAAAAGCCCTTGGAAAGAGTATTTCAATTCTTAGAGAAGAGTGATCTGGGCTG
TGGGGCAGGTGGTGGCCTCAACAATGCCAATGTGTTCCACCTAGCTGGACTTACCTTCCTCACTAATGC
AAATGCAGATGACTCCCAAGAAAATGATGAACCTTGTAAAGAAATTCTCAGGCCAAGAAGAACGCTGCA
AAAGAAGATAGAAGAAATAGCTGCTAAATATAAACATTCAGTAGTGAAGAAATGTTGTTACGATGGAGC
CTGCGTTAATAATGATGAAACCTGTGAGCAGCGAGCTGCACGGATTAGTTTAGGGCCAAGATGCATCAA
AGCTTTCACTGAATGTTGTGTCGTCGTCAAGCCAGCTCCGTGCTAATATCTCTCATAAAGACATGCAATT
GGGAAGGCTACACATGAAGACCCTGTTACCAGTAAGCAAGCCAGAAATTCGGAGTTATTTTCCAGAAAG
CTGGTTGTGGGAAGTTCATCTTGTTCCCAGAAGAAAACAGTTGCAGTTTGCCCTACCTGATTCTCTAAC
CACCTGGGAAATTCAAGGCGTTGGCATTTCAAACACTGGTATATGTGTTGCTGATACTGTCAAGGCAAA
GGTGTTCAAAGATGTCTTCCTGGAAATGAATATACC
ATATTCTGTTGTACGAGGAGAACAGATCCAATTGAAAGGAACTGTTTACAACTATAGGACTTCTGGGAT
GCAGAGTCTCTGGCCCTGTCGCCCAGGCTGGAGTGCAATGGGAAGATCTCGGGTCAACTGCAAGTCCGCCT
GCCAGGTTCAAGCGATTCTCCTGCCTCAGCCTCCCAAGTAGCTGGGATTACAGGCACACACCACCATGC
CCAGCCAACTTGACAGCATTTTAAAGTGTCATGCATATCACTATACTGCCATATTTTATTTAATCTTTA
AATTTTCAGTGCATTTCCATCATATCAAAATAAGAAACAAGTACATCTGTGATATTTGGGCTTAGTTC
CTGTTAATTACCTTTCCTCCTGAGTGTGGGTTACACTTTCCTATTTCTTTTATCTAGTAATTTTGGAT
TGAATCTTCTACTTTATTAATAAAAATATTATAAAGACTCTGGATTCTATTACATT

Figure 69b

>HUMC5_PROT_OF_TR7 SNP reported in patent 389 T->I 802 V->I

MGLLGILCFLIFLGKTWGQEQTYVISAPKIFRVGASENIVIQVYGYTEAFDATISIKSYPDKKFSYSSG
HVBLSSENKFQNSAILTIQPKQLPGGQNPVSYVYLEVVSKHFSKSKRMPITYDNGFLFIRTDKPVYTPD
QSVKVRVYSLNDDLKPAKRETVLTFIDPEGSEVDMVEEIDHIGIISFPDFKIPSNPRYGMWTIKAKYKE
DFSTTGTAYFEVKEYVLPHFSVSIEPEYNFIGYKNFKNFEITIKARYFYNKVVTEADVYITFGIREDLK
DDQKEMMQTAMQNTMLINGIAQVTFDSETAVKELSYYSLEDLNNKYLYIAVTVIESTGGFSEEARIPGI
KYVLSPYKLNLVATPLFLKPGIPYPIKVQVKDSLDQLVGGVPVTLNAQTIDVNQETSDLDPSKSVTRVD
DGVASFVLNLPSGVTVLEFNVKTDAPDLPEENQAREGYRAIAYSSLSQSYLYIDWTDNHKALLVGERLN
IIVTPKSPYIDKITHYNYLILSKGKIIBFGTREKFSDASYQSINIPVTQNMVPSSRLLVYYIVTGEQTA
ELVSDSVWLNIEERCGNQLQVHLSPDADAYSPGQTVSLNMATGMDSWVALAAVDSAVYGVQRGAKKPLE
RVFQFLEKSDLGCGAGGGLNNANVFHLAGLTFLTNANADDSQENDEPCKEILRPRRTLQKKIEEIAAKY
KHSVVKKCCYDGACVNNDETCEQRAARISLGPRCIKAFTECCVVASQLRANISHKDMQLGRLHMKTLLP
VSKPEIRSYFPESWLWEVHLVPRRKQLQFALPDSLTTWEIQGYGISNTGICVAUDTVKAKVFKDVFLEMN
IPYSVVRGEQIQLKGTVYNYRTSGMQ*SLALSPRLECNGKISGQLQVRLPGSSDSPASASQVAGITGTHH
HAQPT*

Figure 69c

>HUMC5_T11 #LN 1112

ATATATCCGTGGTTTCCTGCTACCTCCAACCATGGGCCTTTTGGGAATACTTTGTTTTTAATCTTCCT
GGGGAAAACCTGGGGACAGGAGCAAACATATGTCATTTCAGCACCAAAAATATTCCGTGTTGGAGCATC
TGAAAATATTGTGATTCAAGTTTATGGATACACTGAAGCATTTGATGCAACAATCTCTATTAAAAGTTA
TCCTGATAAAAAATTTAGTTACTCCTCAGGCCATGTTCATTTATCCTCAGAGAATAAATTCCAAAACTC
TGCAATCTTAACAATACAACCAAAACAATTGCCTGGAGGACAAAACCCAGTTTCTTATGTGTATTTGGA
AGTTGTATCAAAGCATTTTTCAAAATCAAAAAGAATGCCAATAACCTATGACAATGGATTTCTCTTCAT
TCATACAGACAAACCTGTTTATACTCCAGACCAGTCAGTAAAAGTTAGAGTTTATTCGTTGAATGACGA
CTTGAAGCCAGCCAAAAGAGAAACTGTCTTAACTTTCATAGATCCTGAAGGATCAGAAGTTGACATGGT
AGAAGAAATTGATCATATTGGAATTATCTCTTTTCCTGACTTCAAGATTCCGTCTAATCCTAGATATGG
TATGTGGACGATCAAGGCTAAATATAAAGAGGACTTTTCAACAACTGGAACCGCATATTTTGAAGTTAA
AGAATATGTCTTGCCACATTTTTCTGTCTCAATCGAGCCAGAATATAATTTCATTGGTTACAAGAACTT
TAAGAATTTTGAAATTACTATAAAAGCAAGATATTTTTATAATAAAGTAGTCACTGAGGCTGACGTTTA
TATCACATTTGGAATAAGAGAAGACTTAAAAGATGATCAAAAAGAAATGATGCAAACAGCAATGCAAAA
CACAATGTT*AAGGGCGGAAGTACGCTGAGAGGCCTATAAAGATGAATGATGACGCAGGAATTGGAAGA
GTCGTGTTTGTCAGCTATTACCAAAAAGACCTGTTGGACCATGTGATGTTCAAGACCCTTCTACTTCTA
TAATTCTATACAAATAATTAGAAAATAACATCCTGGGCTTAATCGTGGACTCGGTTATCTACTTTACTT
TTCACACT*

Figure 69d

>HUMC5_PROT_OF_TR11

MGLLGILCFLIFLGKTWGQEQTYVISAPKIFRVGASENIVIQVYGYTEAFDATISIKSYPDKKFSYSSG
HVBLSSENKFQNSAILTIQPKQLPGGQNPVSYVYLEVVSKHFSKSKRMPITYDNGFLFIHTDKPVYTPD
QSVKVRVYSLNDDLKPAKRETVLTFIDPEGSEVDMVEEIDHIGIISFPDFKIPSNPRYGMWTIKAKYKE
DFSTTGTAYFEVKEYVLPHFSVSIEPEYNFIGYKNFKNFEITIKARYFYNKVVTEADVYITFGIREDLK
DDQKEMMQTAMQNTML*RAEVR*

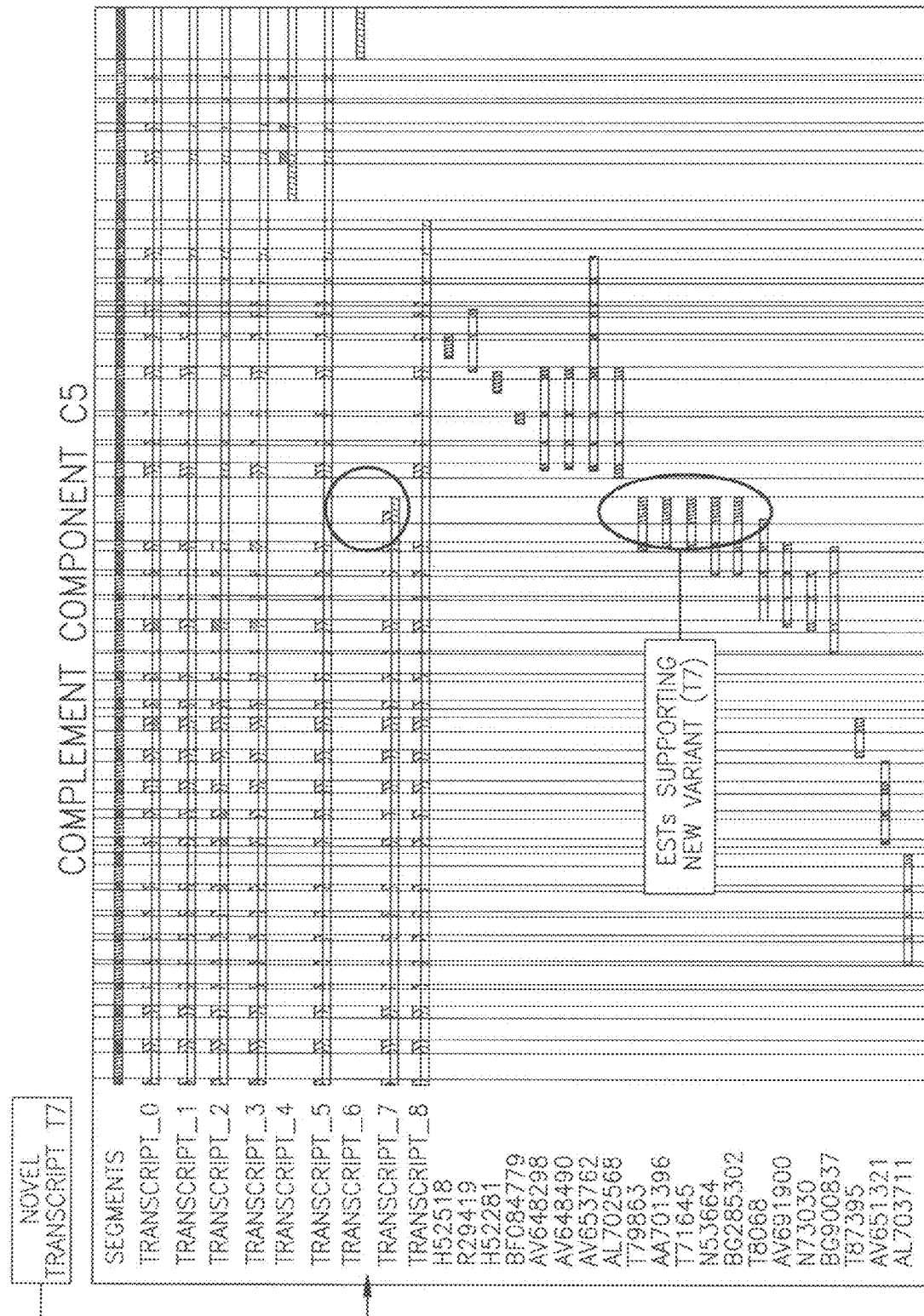

Alignment of Complement component C5 variant T7 (HUMC5_P6 - SEQ ID NO:101) to the wild type protein CO5_HUMAN (SEQ ID NO:147)

```
  1 MGLLGILCFLIFLGKTWGQEQTYVISAPKIFRVGASENIVIQVYGYTEAF  50
    ||||||||||||||||||||||||||||||||||||||||||||||||||
  1 MGLLGILCFLIFLGKTWGQEQTYVISAPKIFRVGASENIVIQVYGYTEAF  50

51 DATISIKSYPDKKFSYSSGHVHLSSENKFQNSAILTIQPKQLPGGQNPVS 100
    ||||||||||||||||||||||||||||||||||||||||||||||||||
 51 DATISIKSYPDKKFSYSSGHVHLSSENKFQNSAILTIQPKQLPGGQNPVS 100

101 YVYLEVVSKHFSKSKRMPITYDNGFLFIHTDKPVYTPDQSVKVRVYSLND 150
    ||||||||||||||||||||||||||||||||||||||||||||||||||
101 YVYLEVVSKHFSKSKRMPITYDNGFLFIHTDKPVYTPDQSVKVRVYSLND 150

151 DLKPAKRETVLTFIDPEGSEVDMVEEIDHIGIISFPDFKIPSNPRYGMWT 200
    ||||||||||||||||||||||||||||||||||||||||||||||||||
151 DLKPAKRETVLTFIDPEGSEVDMVEEIDHIGIISFPDFKIPSNPRYGMWT 200

201 IKAKYKEDFSTTGTAYFEVKEYVLPHFSVSIEPEYNFIGYKNFKNFEITI 250
    ||||||||||||||||||||||||||||||||||||||||||||||||||
201 IKAKYKEDFSTTGTAYFEVKEYVLPHFSVSIEPEYNFIGYKNFKNFEITI 250

251 KARYFYNKVVTEADVYITFGIREDLKDDQKEMMQTAMQNTMLINGIAQVT 300
    ||||||||||||||||||||||||||||||||||||||||||||||||||
251 KARYFYNKVVTEADVYITFGIREDLKDDQKEMMQTAMQNTMLINGIAQVT 300

301 FDSETAVKELSYYSLEDLNNKYLYIAVTVIESTGGFSEEAEIPGIKYVLS 350
    ||||||||||||||||||||||||||||||||||||||||||||||||||
301 FDSETAVKELSYYSLEDLNNKYLYIAVTVIESTGGFSEEAEIPGIKYVLS 350

351 PYKLNLVATPLFLKPGIPYPIKVQVKDSLDQLVGGVPVTLNAQTIDVNQE 400
    |||||||||||||||||||||||||||||||||||||| |||||||||||
351 PYKLNLVATPLFLKPGIPYPIKVQVKDSLDQLVGGVPVILNAQTIDVNQE 400

401 TSDLDPSKSVTRVDDGVASFVLNLPSGVTVLEFNVKTDAPDLPEENQARE 450
    ||||||||||||||||||||||||||||||||||||||||||||||||||
401 TSDLDPSKSVTRVDDGVASFVLNLPSGVTVLEFNVKTDAPDLPEENQARE 450

451 GYRAIAYSSLSQSYLYIDWTDNHKALLVGEHLNIIVTPKSPYIDKITHYN 500
    ||||||||||||||||||||||||||||||||||||||||||||||||||
451 GYRAIAYSSLSQSYLYIDWTDNHKALLVGEHLNIIVTPKSPYIDKITHYN 500

501 YLILSKGKIIHFGTREKFSDASYQSINIPVTQNMVPSSRLLVYYIVTGEQ 550
    ||||||||||||||||||||||||||||||||||||||||||||||||||
501 YLILSKGKIIHFGTREKFSDASYQSINIPVTQNMVPSSRLLVYYIVTGEQ 550

551 TAELVSDSVWLNIEEKCGNQLQVHLSPDADAYSPGQTVSLNMATGMDSWV 600
    ||||||||||||||||||||||||||||||||||||||||||||||||||
551 TAELVSDSVWLNIEEKCGNQLQVHLSPDADAYSPGQTVSLNMATGMDSWV 600

601 ALAAVDSAVYGVQRGAKKPLERVFQFLEKSDLGCGAGGGLNNANVFHLAG 650
    ||||||||||||||||||||||||||||||||||||||||||||||||||
601 ALAAVDSAVYGVQRGAKKPLERVFQFLEKSDLGCGAGGGLNNANVFHLAG 650
```

```
651 LTFLTNANADDSQENDEPCKEILRPRRTLQKKIEEIAAKYKHSVVKKCCY 700
    ||||||||||||||||||||||||||||||||||||||||||||||||||
651 LTFLTNANADDSQENDEPCKEILRPRRTLQKKIEEIAAKYKHSVVKKCCY 700

701 DGACVNNDETCEQRAARISLGPRCIKAFTECCVVASQLRANISHKDMQLG 750
    ||||||||||||||||||||||||||||||||||||||||||||||||||
701 DGACVNNDETCEQRAARISLGPRCIKAFTECCVVASQLRANISHKDMQLG 750

751 RLHMKTLLPVSKPEIRSYFPESWLWEVHLVPRRKQLQFALPDSLTTWEIQ 800
    ||||||||||||||||||||||||||||||||||||||||||||||||||
751 RLHMKTLLPVSKPEIRSYFPESWLWEVHLVPRRKQLQFALPDSLTTWEIQ 800

801 GVGISNTGICVADTVKAKVFKDVFLEMNIPYSVVRGEQIQLKGTVYNYRT 850
    |  |||||||||||||||||||||||||||||||||||||||||||||||
801 GIGISNTGICVADTVKAKVFKDVFLEMNIPYSVVRGEQIQLKGTVYNYRT 850

851 SGMQSLALSPRLECNGKISGQLQVRLPGSSDSPASASQVAGITGTHHHAQ 900
    ||||
851 SGMQ...................................... 854

Alignment of Complement component C5 variant T11 (HUMC5_P7 - SEQ ID NO: 104) to the wild type protein CO5_HUMAN (SEQ ID NO:147)

```
  1 MGLLGILCFLIFLGKTWGQEQTYVISAPKIFRVGASENIVIQVYGYTEAF  50
    |||||||||||||||||||||||||||||||||||||||||||||||||
  1 MGLLGILCFLIFLGKTWGQEQTYVISAPKIFRVGASENIVIQVYGYTEAF  50

51 DATISIKSYPDKKFSYSSGHVHLSSENKFQNSAILTIQPKQLPGGQNPVS 100
    |||||||||||||||||||||||||||||||||||||||||||||||||
 51 DATISIKSYPDKKFSYSSGHVHLSSENKFQNSAILTIQPKQLPGGQNPVS 100

101 YVYLEVVSKHFSKSKRMPITYDNGFLFIHTDKPVYTPDQSVKVRVYSLND 150
    |||||||||||||||||||||||||||||||||||||||||||||||||
101 YVYLEVVSKHFSKSKRMPITYDNGFLFIHTDKPVYTPDQSVKVRVYSLND 150

151 DLKPAKRETVLTFIDPEGSEVDMVEEIDHIGIISFPDFKIPSNPRYGMWT 200
    |||||||||||||||||||||||||||||||||||||||||||||||||
151 DLKPAKRETVLTFIDPEGSEVDMVEEIDHIGIISFPDFKIPSNPRYGMWT 200

201 IKAKYKEDFSTTGTAYFEVKEYVLPHFSVSIEPEYNFIGYKNFKNFEITI 250
    |||||||||||||||||||||||||||||||||||||||||||||||||
201 IKAKYKEDFSTTGTAYFEVKEYVLPHFSVSIEPEYNFIGYKNFKNFEITI 250

251 KARYFYNKVVTEADVYITFGIREDLKDDQKEMMQTAMQNTMLRAEVR    297
    ||||||||||||||||||||||||||||||||||||||||||
251 KARYFYNKVVTEADVYITFGIREDLKDDQKEMMQTAMQNTML.....    292
```

Figure 72

C5 structure

| | | | | |
|---|---|---|---|---|
| w.t | SP | α2-macroglobulin 19-673 | Anaphilo-toxin-like 678-751 | α2-macroglobulin 752-1531 | NTR 1532-1676 |

| T7 | SP | α2-macroglobulin 19-673 | Anaphilo-toxin-like 678-751 | α2-macroglobulin 752-854 | 48a.a |

| T11 | SP | α2-macroglobulin 19-292 | 5a.a |

Figure 73a

>HSCR1RS_T5 #LN 676

ACACTCTGGGCGCGGAGCACAATGATTGGTCACTCCTATTTTCGCTGAGCTTTTCCTCTTATTTCAGTT
TTCTTCGAGATCAAATCTGGTTTGTAGATGTGCTTGGGGAGAATGGGGGCCTCTTCTCCAAGAAGCCCG
GAGCCTGTCGGGCCGCCGGCGCCCGGTCTCCCCTTCTGCTGCGGAGGATCCCTGCTGGCGGTTGTGGTG
CTGCTTGCGCTGCCGGTGGCCTGGGGTCAATGCAATGCCCCAGAATGGCTTCCATTTGCCAGGCCTACC
AACCTAACTGATGAGTTTGAGTTTCCCATTGGGACATATCTGAACTATGAATGCCGCCCTGGTTATTCC
GGAAGACCGTTCTATCATCTGCCTAAAAAACTCAGTCTGGACTGGTGCTAAGGACAGGTGCAGACGTA
AATCATGTCGTAATCCTCCAGATCCTGTGAATGGCATGGTGCATGTGATCAAAGGCATCCAGTTCGGAT
CCCAAATTAAATATTCTTGTACTAAAGGATACCGACTCATTGGTTCCTCGTCTGCCACATGCATCATCT
CAGGTGATACTGTCATTTGGGATAATGAAACACCTATTTGTGACAG*TGAGTTGAAATATCCCTTCCTAT*
*TTCTTTTACCGACACATTCTAATTTTTCTCTGGAATAATAAAAATCTTAACTGA*

Figure 73b

>HSCR1RS_PROT_OF_TR5

MGASSPRSPEPVGPPAPGLPFCCGGSLLAVVVLLALPVAWGQCNAPEWLPFARPTNLTDEFEFPIGTYL
NYECRPGYSGRPFSIICLKNSVWTGAKDRCRRKSCRNPPDPVNGMVHVIKGIQFGSQIKYSCTKGYRLI
GSSSATCIISGDTVIWDNETPICD*SEIKYPFLFLLPTHSNFSLE*

Figure 75

Alignment of the Complement Receptor CR1 variant T5
(HSCR1RS_P6 - SEQ ID NO:107) to the wild type protein
CR1_HUMAN (SEQ ID NO:148)

```
  1 MGASSPRSPEPVGPPAPGLPFCCGGSLLAVVVLLALPVAWGQCNAPEWLP  50
    ||||||||||||||||||||||||||||||||||||||||||||||||||
  1 MGASSPRSPEPVGPPAPGLPFCCGGSLLAVVVLLALPVAWGQCNAPEWLP  50

51 FARPTNLTDEFEFPIGTYLNYECRPGYSGRPFSIICLKNSVWTGAKDRCR 100
    ||||||||||||||||||||||||||||||||||||||||||||||||||
 51 FARPTNLTDEFEFPIGTYLNYECRPGYSGRPFSIICLKNSVWTGAKDRCR 100

101 RKSCRNPPDPVNGMVHVIKGIQFGSQIKYSCTKGYRLIGSSSATCIISGD 150
    ||||||||||||||||||||||||||||||||||||||||||||||||||
101 RKSCRNPPDPVNGMVHVIKGIQFGSQIKYSCTKGYRLIGSSSATCIISGD 150

151 TVIWDNETPICDSELKYPFLFLLPTHSNFSLE                   182
    ||||||||||||
151 TVIWDNETPICD....................                   162
```

>HSINTAL4_T2 (SEQ ID NO:111) SNPs locations: 759 G→A; 767 C→. (deletion); 932 C→. (deletion); 993 C→. (deletion); 1140 C→T; 3013 A→G; 3822 G→A; 4072 T→C; 4168 G→A; 4939 G→T; 5150 C→T; 5600 T→C;

```
GGCAGGGCACACCTGGATTGCATTAGAATGAGACTCACTACCCAGTTCAGGTGTGTTGCG
TTGTGGGTCTCCGGCACATTTCAGAGGCTGATTAGGACCCTGACCCCACACTGGGGTTTA
CACCCCTAAAAGCAGGTGTGTCCCGTGGCAACTGAGTGGGTGCGTGAAAAGGGGGGATCA
TCAATTACCAGCTGGAGCAATCGAATCGGTTAAAGTGAATCAAGTCACAGTGCTTCCTTA
ACCCAACCTCTCTGTTGGGGTCAGCCACAGCCTAAACCGCCTGCCGTTCAGCCTGAGAGG
CTGCTGCTAGCCTGCTCACGCATGCAGCCCGGGCTGCAGAGGAAGTGTGGGGAGGAAGGA
AGTGGGTATAGAAGGGTGCTGAGATGTGGGTCTTGAAGAGAATAGCCATAACGTCTTTGT
CACTAAAATGTTCCCCAGGGGCCTTCGGCGAGTCTTTTTGTTTGGTTTTTTGTTTTTAAT
CTGTGGCTCTTGATAATTTATCTAGTGGTTGCCTACACCTGAAAAACAAGACACAGTGTT
TAACTATCAACGAAAGAACTGGACGGCTCCCCGCCGCAGTCCCACTCCCCGAGTTTGTGG
CTGGCATTTGGGCCACGCCGGGCTGGGCGGTCACAGCGAGGGGCGCGCAGTTTGGGGTCA
CACAGCTCCGCTTCTAGGCCCCAACCACGTTAAAAGGGGAAGCCCGTGCCCCATCAGGT
CCGCTCTTGCTGAGCCCAGAGCCATCCCGCGCTCTGCGGGCTGGGAGGCCCGGGCCAGGA
CGCGAGTCCTGCGCAGCCGAGGTTCCCCAGCGCCCCCTGCAGCCGCGCGTAGGCAGAGAC
GGAGCCCGGCCCTGCGCCTCCGCACCACGCCCGGGACCCCACCCAGCGGCCCGTACCCGG
AGAAGCAGCGCGAGCACCCGAAGCTCCCGGCTCGGCGGCAGAAACCGGGAGTGGGGCCGG
GCGAGTGCGCGCATCCCAGGCCGGCCCGAACGCTCCGCCCGCGGTGGGCCGACTTCCCC
TCCTCTTCCCTCTCTCCTTCCTTTAGCCCGCTGGCGCCGGACACGCTGCGCCTCATCTCT
TGGGGCCTTCTTCCCCGTTGGCCAACCGTCGCATCCCGTGCAACTTTGGGGTAGTGGCCG
CTTAGTGTTGAATGTTCCCCACCGAGAGCGCATGGCTTGGGAAGCGAGGCGCGAACCCGG
CCCCCGAAGCCGCCGTCCGGGAGACGGTGATGCTGTTGCTGTGCCTGGGGGTCCCGACCG
GCCGCCCCTACAACGTGGACACTGAGAGCGCGCTGCTTTACCAGGGCCCCCACAACACGC
TGTTCGGCTACTCGGTCGTGCTGCACAGCCACGGGGCGAACCGATGGCTCCTAGTGGGTG
CGCCCACTGCCAACTGGCTCGCCAACGCTTCAGTGATCAATCCCGGGGCGATTTACAGAT
GCAGGATCGGAAAGAATCCCGGCCAGACGTGCGAACAGCTCCAGCTGGGTAGCCCTAATG
GAGAACCTTGTGGAAAGACTTGTTTGGAAGAGAGAGACAATCAGTGGTTGGGGGTCACAC
TTTCCAGACAGCCAGGAGAAAATGGATCCATCGTGACTTGTGGGCATAGATGGAAAAATA
TATTTTACATAAAGAATGAAAATAAGCTCCCCACTGGTGGTTGCTATGGAGTGCCCCCTG
ATTTACGAACAGAACTGAGTAAAAGAATAGCTCCGTGTTATCAAGATTATGTGAAAAAAT
TTGGAGAAAATTTTGCATCATGTCAAGCTGGAATATCCAGTTTTTACACAAAGGATTTAA
TTGTGATGGGGCCCCAGGATCATCTTACTGGACTGGCTCTCTTTTTGTCTACAATATAA
CTACAAATAAATACAAGGCTTTTTTAGACAAACAAAATCAAGTAAAATTTGGAAGTTATT
TAGGATATTCAGTCGGAGCTGGTCATTTTCGGAGCCAGCATACTACCGAAGTAGTCGGAG
GAGCTCCTCAACATGAGCAGATTGGTAAGGCATATATATTCAGCATTGATGAAAAGAAC
TAAATATCTTACATGAAATGAAAGGTAAAAAGCTTGGATCGTACTTTGGAGCTTCTGTCT
GTGCTGTGGACCTCAATGCAGATGGCTTCTCAGATCTGCTCGTGGGAGCACCCATGCAGA
GCACCATCAGAGAGGAAGGAAGAGTGTTTGTGTACATCAACTCTGGCTCGGGAGCAGTAA
TGAATGCAATGGAAACAAACCTCGTTGGAAGTGACAAATATGCTGCAAGATTTGGGGAAT
CTATAGTTAATCTTGGCGACATTGACAATGATGGCTTTGAAGATGTTGCTATCGGAGCTC
CACAAGAAGATGACTTGCAAGGTGCTATTTATATTTACAATGGCCGTGCAGATGGGATCT
CGTCAACCTTCTCACAGAGAATTGAAGGACTTCAGATCAGCAAATCGTTAAGTATGTTTG
GACAGTCTATATCAGGACAAATTGATGCAGATAATAATGGCTATGTAGATGTAGCAGTTG
GTGCTTTTCGGTCTGATTCTGCTGTCTTGCTAAGGACAAGACCTGTAGTAATTGTTGACG
CTTCTTTAAGCCACCCTGAGTCAGTAAATAGAACGAAATTTGACTGTGTTGAAAATGGAT
GGCCTTCTGTGTGCATAGATCTAACACTTTGTTTCTCATATAAGGGCAAGGAAGTTCCAG
GTTACATTGTTTTGTTTTATAACATGAGTTTGGATGTGAACAGAAAGGCAGAGTCTCCAC
CAAGATTCTATTTCTCTTCTAATGGAACTTCTGACGTGATTACAGGAAGCATACAGGTGT
CCAGCAGAGAAGCTAACTGTAGAACACATCAAGCATTTATGCGGAAAGATGTGCGGGACA
TCCTCACCCCCAATTCAGATTGAAGCTGCTTACCACCTTGGTCCTCATGTCATCAGTAAAC
GAAGTACAGAGGAATTCCCACCACTTCAGCCAATTCTTCAGCAGAAGAAAGAAAAGACA
TAATGAAAAAAACAATAAACTTTGCAAGGTTTTGTGCCCATGAAAATTGTTCTGCTGATT
TACAGGTTTCTGCAAAGATTGGGTTTTTGAAGCCCCATGAAAATAAAACATATCTTGCTG
```

```
TTGGGAGTATGAAGACATTGATGTTGAATGTGTCCTTGTTTAATGCTGGAGATGATGCAT
ATGAAACGACTCTACATGTCAAACTACCCGTGGGTCTTTATTTCATTAAGATTTTAGAGC
T*GTTGTTTCATTTTTCCCATTA*GGAAGAGAAGCAAATAAACTGTGAAGTCACAGATAACT
CTGGCGTGGTACAACTTGACTGCAGTATTGGCTATATATATGTAGATCATCTCTCAAGGA
TAGATATTAGCTTTCTCCTGGATGTGAGCTCACTCAGCAGAGCGGAAGAGGACCTCAGTA
TCACAGTGCATGCTACCTGTGAAAATGAAGAGGAAATGGACAATCTAAAGCACAGCAGAG
TGACTGTAGCAATACCTTTAAAATATGAGGTTAAGCTGACTGTTCATGGGTTTGTAAACC
CAACTTCATTTGTGTATGGATCAAATGATGAAAATGAGCCTGAAACGTGCATGGTGGAGA
AAATGAACTTAACTTTCCATGTTATCAACACTGGCAATAGTATGGCTCCCAATGTTAGTG
TGGAAATAATGGTACCAAATTCTTTTAGCCCCCAAACTGATAAGCTGTTCAACATTTTGG
ATGTCCAGACTACTACTGGAGAATGCCACTTTGAAAATTATCAAAGAGTGTGTGCATTAG
AGCAGCAAAAGAGTGCAATGCAGACCTTGAAAGGCATAGTCCGGTTCTTGTCCAAGACTG
ATAAGAGGCTATTGTACTGCATAAAAGCTGATCCACATTGTTAAATTCTTGTGTAATT
TTGGGAAAATGGAAAGTGGAAAAGAAGCCAGTGTTCATATCCAACTGGAAGGCCGGCCAT
CCATTTTAGAAATGGATGAGACTTCAGCACTCAAGTTTGAAATAAGAGCAACAGGTTTTC
CAGAGCCAAATCCAAGAGTAATTGAACTAAACAAGGATGAGAATGTTGCGCATGTTCTAC
TGGAAGGACTACATCATCAAAGACCCAAACGTTATTTCACCATAGTGATTATTTCAAGTA
GCTTGCTACTTGGACTTATTGTACTTCTGTTGATCTCATATGTTATGTGGAAGGCTGGCT
TCTTTAAAAGACAATACAAATCTATCCTACAAGAAGAAAACAGAAGAGACAGTTGGAGTT
ATATCAACAGTAAAAGCAATGATGATTAAGGACTTCTTTCAAATTGAGAGAATGGAAAAC
AGACTCAGGTTGTAGTAAAGAAATTTAAAAGACACTGTTTACAAGAAAAAATGAATTTTG
TTTGGACTTCTTTTACTCATGATCTTGTGACATATTATGTCTTCATGCAAGGGGAAAATC
TCAGCAATGATTACTCTTTGAGATAGAAGAACTGCAAAGGTAATAATACAGCCAAAGATA
ATCTCTCAGCTTTTAAATGGGTAGAGAAACACTAAAGCATTCAATTTATTCAAGAAAAGT
AAGCCCTTGAAGATATCTTGAAATGAAAGTATAACTGAGTTAAATTATACTGGAGAAGTC
TTAGACTTGAAATACTACTTACCATATGTGCTTGCCTCAGTAAAATGAACCCCACTGGGT
GGGCAGAGGTTCATTTCAAATACATCTTTGATACTTGTTCAAAATATGTTCTTTAAAAAT
ATAATTTTTTAGAGAGCTGTTCCCAAATTTTCTAACGAGTGGACCATTATCACTTTAAAG
CCCTTTATTTATAATACATTTCCTACGGGCTGTGTTCCAACAACCATTTTTTTTCAGCAG
ACTATGAATATTATAGTATTATAGGCCAAACTGGCAAACTTCAGACTGAACATGTACACT
GGTTTGAGCTTAGTGAAATGACTTCTGGATAATTATTTTTTATAATTATGGATTTCACC
ATCTTTCTTTCTGTATATATACATGTGTTTTTATGTAGGTATATATTTACCATTCTTCCT
ATCTATTCTTCCTATAACACACCTTTATCAAGCATACCCAGGAGTAATCTTCAAATCTTT
TGTTATATTCTGAAACAAAAGATTGTGAGTGTTGCACTTTACCTGATACACGCTGATTTA
GAAAATACAGAAACCATACCTCACTAATAACTTTAAAATCAAAGCTGTGCAAAGACTAGG
GGGCCTATACTTCATATGTATTATGTACTATGTAAAATATTGACTATCACACAACTATTT
CCTTGGATGTAATTCTTTGTTACCCTTTACAAGTATAAGTGTTACCTTACATGGAAACGA
AGAAACAAAATTCATAAATTTAAATTCATAAATTTAGCTGAAAGATACTGATTCAATTTG
TATACAGTGAATATAAATGAGACGACAGCAAAATTTTCATGAAATGTAAAATATTTTTAT
AGTTTGTTCATACTATATGAGGTTCTATTTTAAATGACTTTCTGGATTTTAAAAAATTTC
TTTAAATACAATCATTTTTGTAATATTTATTTATGCTTATGATCTAGATAAGTGCAGAA
TATCATTTTATCTGACTCTGTCTTCATAAGAGAGCTGTGGCCGAATTTTGAACATCTGTT
ATAGGGAGTGATCAAATTAGAAGGCAATGTGGAAAAACAATTCTGGGAAAGATTTCTTTA
TATGAAGTCCCTGCCACTAGCCAGCCATCCTAATTGATGAAAGTTATCTGTTCACAGGCC
TGCAGTGATGGTGAGGAATGTTCTGAGATTTGCGAAGGCATTTGAGTAGTGAAATGTAAG
CACAAAACCTCCTGAACCCAGAGTGTGTATACACAGGAATAAACTTTATGACATTTATGT
ATTTTTAAAAAACTTTGTATCGTTATAAAAAGGCTAGTCATTCTTTCAGGAGAACATCTA
GGATCATAGATGAAAAATCAAGCCCCGATTTAGAACTGTCTTCTCCAGGATGGTCTCTAA
GGAAATTTACATTTGGTTCTTTCCTACTCAGAACTACTCAGAAACAACTATATATTTCAG
GTTATTTGAGCACAGTGAAAGCAGAGTACTATGGTTGTCCAACACAGGCCTCTCAGATAC
AAGGGGAACACAATTACATATTGGGCTAGATTTTGCCCAGTTCAAAATAGTATTTGTTAT
CAACTTACTTTGTTACTTGTATCATGAATTTTAAAACCCTACCACTTTAAGAAGACAGGG
ATGGGTTATTCTTTTTTGGCAGGTAGGCTATATAACTATGTGATTTTGAAATTTAACTGC
TCTGCGATTAGGGAGCAGTGAATCAAGGCAGACTTATGAAATCTGTATTATATTTGTAACA
GAATATAGGAAATTTAACATAATTGATGAGCTCAAATCCTGAAAAATGAAAGAATCCAAA
TTATTTCAGAATTATCTAGGTTAAATATTGATGTATTATGATGGTTGCAAAGTTTTTTTG
TGTGTCCAATAAACACATTGTA
```

Figure 78

>HSINTAL4_P2 UNREPORTED SNP A=>G in amino acid #17

MPPTESAWLGKRGANPAPEAAVRETVMLLLCLGVPTGRPYNVDTESALLYQGPHNTLFGY
SVVLHSHGANRWLLVGAPTANWLANASVINPGAIYRCRIGKNPGQTCEQLQLGSPNGEPC
GKTCLEERDNQWLGVTLSRQPGENGSIVTCGHRWKNIFYIKNENKLPTGGCYGVPPDLRT
ELSKRIAPCYQDYVKKFGENFASCQAGISSFYTKDLIVMGAPGSSYWTGSLFVYNITTNK
YKAFLDKQNQVKFGSYLGYSVGAGHFRSQHTTEVVGGAPQHEQIGKAYIFSIDEKELNIL
HEMKGKKLGSYFGASVCAVDLNADGFSDLLVGAPMQSTIREEGRVFVYINSGSGAVMNAM
ETNLVGSDKYAARFGESIVNLGDIDNDGFEDVAIGAPQEDDLQGAIYIYNGRADGISSTF
SQRIEGLQISKSLSMFGQSISGQIDADNNGYVDVAVGAFRSDSAVLLRTRPVVIVDASLS
HPESVNRTKFDCVENGWPSVCIDLTLCFSYKGKEVPGYIVLFYNMSLDVNRKAESPPRFY
PSSNGTSDVITGSIQVSSREANCRTHQAFMRKDVRDILTPIQIEAAYHLGPHVISKRSTE
EPPPLQPILQQKKEKDIMKKTINPARFCAHENCSADLQVSAKIGFLKPHENKTYLAVGSM
KTLMLNVSLFNAGDDAYETTLHVKLPVGLYFIKILELLFHFSH

Alignment of Integrin alpha 4 variant T2 HSINTAL4_P2 (SEQ ID NO:110) to the wild type protein ITA4_HUMAN (SEQ ID NO:149)

```
  1 MFPTESAWLGKRGANPAPEAAVRETVMLLLCLGVPTGRPYNVDTESAL  48
    ||||||||||||||| ||||||||||||||||||||||||||||||||
  1 MFPTESAWLGKRGANPGPEAAVRETVMLLLCLGVPTGRPYNVDTESAL  48

49 LYQGPHNTLFGYSVVLHSHGANRWLLVGAPTANWLANASVINPGAIYRCR  98
    |||||||||||||||||||||||||||||||||||||||||||||||||
 49 LYQGPHNTLFGYSVVLHSHGANRWLLVGAPTANWLANASVINPGAIYRCR  98

99 IGKNPGQTCEQLQLGSPNGEPCGKTCLEERDNQWLGVTLSRQPGENGSIV 148
    |||||||||||||||||||||||||||||||||||||||||||||||||
 99 IGKNPGQTCEQLQLGSPNGEPCGKTCLEERDNQWLGVTLSRQPGENGSIV 148

149 TCGHRWKNIFYIKNENKLPTGGCYGVPPDLRTELSKRIAPCYQDYVKKFG 198
    |||||||||||||||||||||||||||||||||||||||||||||||||
149 TCGHRWKNIFYIKNENKLPTGGCYGVPPDLRTELSKRIAPCYQDYVKKFG 198

199 ENFASCQAGISSFYTKDLIVMGAPGSSYWTGSLFVYNITTNKYKAFLDKQ 248
    |||||||||||||||||||||||||||||||||||||||||||||||||
199 ENFASCQAGISSFYTKDLIVMGAPGSSYWTGSLFVYNITTNKYKAFLDKQ 248

249 NQVKFGSYLGYSVGAGHFRSQHTTEVVGGAPQHEQIGKAYIFSIDEKELN 298
    |||||||||||||||||||||||||||||||||||||||||||||||||
249 NQVKFGSYLGYSVGAGHFRSQHTTEVVGGAPQHEQIGKAYIFSIDEKELN 298

299 ILHEMKGKKLGSYFGASVCAVDLNADGFSDLLVGAPMQSTIREEGRVFVY 348
    |||||||||||||||||||||||||||||||||||||||||||||||||
299 ILHEMKGKKLGSYFGASVCAVDLNADGFSDLLVGAPMQSTIREEGRVFVY 348

349 INSGSGAVMNAMETNLVGSDKYAARFGESIVNLGDIDNDGFEDVAIGAPQ 398
    |||||||||||||||||||||||||||||||||||||||||||||||||
349 INSGSGAVMNAMETNLVGSDKYAARFGESIVNLGDIDNDGFEDVAIGAPQ 398

399 EDDLQGAIYIYNGRADGISSTFSQRIEGLQISKSLSMFGQSISGQIDADN 448
    |||||||||||||||||||||||||||||||||||||||||||||||||
399 EDDLQGAIYIYNGRADGISSTFSQRIEGLQISKSLSMFGQSISGQIDADN 448

449 NGYVDVAVGAFRSDSAVLLRTRPVVIVDASLSHPESVNRTKFDCVENGWP 498
    |||||||||||||||||||||||||||||||||||||||||||||||||
449 NGYVDVAVGAFRSDSAVLLRTRPVVIVDASLSHPESVNRTKFDCVENGWP 498

499 SVCIDLTLCFSYKGKEVPGYIVLFYNMSLDVNRKAESPPRFYFSSNGTSD 548
    |||||||||||||||||||||||||||||||||||||||||||||||||
499 SVCIDLTLCFSYKGKEVPGYIVLFYNMSLDVNRKAESPPRFYFSSNGTSD 548

549 VITGSIQVSSREANCRTHQAFMRKDVRDILTPIQIEAAYHLGPHVISKRS 598
    |||||||||||||||||||||||||||||||||||||||||||||||||
549 VITGSIQVSSREANCRTHQAFMRKDVRDILTPIQIEAAYHLGPHVISKRS 598

599 TEEFPPLQPILQQKKEKDIMKKTINFARFCAHENCSADLQVSAKIGFLKP 648
    |||||||||||||||||||||||||||||||||||||||||||||||||
599 TEEFPPLQPILQQKKEKDIMKKTINFARFCAHENCSADLQVSAKIGFLKP 648
```

```
649  HENKTYLAVGSMKTLMLNVSLFNAGDDAYETTLHVKLPVGLYFIKILELL  698
     ||||||||||||||||||||||||||||||||||||||||||||||||
649  HENKTYLAVGSMKTLMLNVSLFNAGDDAYETTLHVKLPVGLYFIKILEL.  697

699  FHFSH                                              703

Integrin α4 structure

W.T | FG | FG | FG | FG | FG | FG | FG |                    | TM | Cyto |
              41-485                         486-983           984   1008
                                                              -1007 -1038

```
>HUMUPAA_T6 #LN 3037 (SEQ ID NO:114) NEW EDGE ][

ATAAAAACAGGCCTGCCTCAGCTCCCTCATGGCCCTGTCCACTGAGCATCCTCCCGCCAC
ACAGAAACCCGCCCAGCCGGGGCCACCGACCCCACCCCCTGCCTGGAAACTTAAAGGAGG
CCGGAGCTGTGGGGAGCTCAGAGCTGAGATCCTACAGGAGTCCAGGGCTGGAGAGAAAAC
CTCTGCGAGGAAAGGGAAGGAGCAAGCCGTGCCAGGCACAGTGGCACATGCCTGAAGTCC
CAGCTCTGGGAAGCTGAGGCAGGAGGATCTCTTGAGCCTGGTGGGTCAAGGCTGCAGTGA
ACCATGTTCATGCCACTGCACTCCAGTCTGGATGACAGAGCGAGACCTAGTCTCAAAAAA
AAAAAAAAAAAAAGAAAGAAGAAAGAAGAAAGGAAAAAGAAAAAAAGGCAGCGGGGCG
CGGTGGCTCACGCCTGTAATCCCACCACTTTGGGAGGCCAAGGCGAGCGGATCACGAGGT
CAGGAGATCGAGACCATCCTGGCTAACACGGTGAAACCCGTCTCTACTAAAAATACAAA
AATTAGCCGGGCGTGGTGGCAGGCGCCTGTAGTCCCAGCTACTCAGGAGGCTGAGACATG
AGAATGGCATGAACCCGGGAGGCGGAGCTTGTAGTGAGCCGAGATCACACCACTGCACTC
CAGCCTGGGCGACAGAGCGAGACTCCATCTTAAAAGAAAAAAAAAAAAGGACATGCTAC
AGCATGGATGCACCTTGAAGACATTTGCAAAGTGAAACAAACCAGTCGCAAAAGAAGAAA
CACTGTCTCATTCCACTTCTAGGATAATTTAAGGGACGCTGTGAAGCAATCATGGATGCA
ATGAAGAGAGGGCTCTGCTGTGTGCTGCTGCTGTGTGGAGCAGTCTTCGTTTCGCCCAGC
CAGGAAATCCATGCCCGATTCAGAAGAGGAGCCAGATCTTACCAAGTGATCTGCAGAGAT
GAAAAAACGCAGATGATATACCAGCAACATCA] [CTACAGGGGCACGTGGAGCACAGCGGAG
AGTGGCGCCGAGTGCACCAACTGGAACAGCAGCGCGTTGGCCCAGAAGCCCTACAGCGGG
CGGAGGCCAGACGCCATCAGGCTGGGCCTGGGGAACCACAACTACTGCAGAAACCCAGAT
CGAGACTCAAAGCCCTGGTGCTACGTCTTTAAGGCGGGGAAGTACAGCTCAGAGTTCTGC
AGCACCCCTGCCTGCTCTGAGGGAAACAGTGACTGCTACTTTGGGAATGGGTCAGCCTAC
CGTGGCACGCACAGCCTCACCGAGTCGGGTGCCTCCTGCCTCCCGTGGAATTCCATGATC
CTGATAGGCAAGGTTTACACAGCACAGAACCCCAGTGCCCAGGCACTGGGCCTGGGCAAA
CATAATTACTGCCGGAATCCTGATGGGGATGCCAAGCCCTGGTGCCACGTGCTGAAGAAC
CGCAGGCTGACGTGGGAGTACTGTGATGTGCCCTCCTGCTCCACCTGCGGCCTGAGACAG
TACAGCCAGCCTCAGTTTCGCATCAAAGGAGGGCTCTTCGCCGACATCGCCTCCCACCCC
TGGCAGGCTGCCATCTTTGCCAAGCACAGGAGGTCGCCCGGAGAGCGGTTCCTGTGCGGG
GGCATACTCATCAGCTCCTGCTGGATTCTCTCTGCCGCCCACTGCTTCCAGGAGAGGTTT
CCGCCCCACCACCTGACGGTGATCTTGGGCAGAACATACCGGGTGGTCCCTGGCGAGGAG
GAGCAGAAATTTGAAGTCGAAAAATACATTGTCCATAAGGAATTCGATGATGACACTTAC
GACAATGACATTGCGCTGCTGCAGCTGAAATCGGATTCGTCCCGCTGTGCCCAGGAGAGC
AGCGTGGTCCGCACTGTGTGCCTTCCCCGGCGGACCTGCAGCTGCCGGACTGGACGGAG
TGTGAGCTCTCCGGCTACGGCAAGCATGAGGCCTTGTCTCCTTTCTATTCGGAGCGGCTG
AAGGAGGCTCATGTCAGACTGTACCCATCCAGCCGCTGCACATCACAACATTTACTTAAC
AGAACAGTCACCGACAACATGCTGTGTGCTGGAGACACTCGGAGCGGCGGGCCCCAGGCA
AACTTGCACGACGCCTGCCAGGGCGATTCGGGAGGCCCCTGGTGTGTCTGAACGATGGC
CGCATGACTTTGGTGGGCATCATCAGCTGGGGCCTGGGCTGTGGACAGAAGGATGTCCCG
GGTGTGTACACCAAGGTTACCAACTACCTAGACTGGATTCGTGACAACATGCGACCGTGA
CCAGGAACACCCGACTCCTCAAAAGCAAATGAGATCCCGCCTCTTCTTCTTCAGAAGACA
CTGCAAAGGCGCAGTGCTTCTCTACAGACTTCTCCAGACCCACCACACCGCAGAAGCGGG
ACGAGACCCTACAGGAGAGGGAAGAGTGCATTTTCCCAGATACTTCCCATTTTGGAAGTT
TTCAGGACTTGGTCTGATTTCAGGATACTCTGTCAGATGGGAAGACATGAATGCACACTA
GCCTCTCCAGGAATGCCTCCTCCCTGGGCAGAAAGTGGCCATGCCACCCTGTTTTCAGCT
AAAGCCCAACCTCCTGACCTGTCACCGTGAGCAGCTTTGGAAACAGGACCACAAAAATGA
AAGCATGTCTCAATAGTAAAGATAACAAGATCTTTCAGGAAAGACGGATTGCATTAGAA
ATAGACAGTATATTTATAGTCACAAGAGCCCAGCAGGGCCTCAAAGTTGGGGCAGGCTGG
CTGGCCCGTCATGTTCCTCAAAAGCACCCTTGACGTCAAGTCTCCTTCCCCTTTCCCCAC
TCCCTGGCTCTCAGAAGGTATTCCTTTTGTGTACAGTGTGTAAAGTGTAAATCCTTTTTC
TTTATAAACTTTAGAGTAGCATGAGAGAATTGTATCATTTGAACAACTAGGCTTCAGCAT
ATTTATAGCAATCCATGTTAGTTTTTACTTTCTGTTGCCACAACCCTGTTTTATACTGTA
CTTAATAAATTCAGATATATTTTTCACAGTTTTTCCA
```

Figure 82b

>HUMUPAA_P4 (SEQ ID NO:113) NEW EDGE ] [

MDAMKRGLCCVLLLCGAVFVSPSQEIHARFRRGARSYQVICRDEKTQMIYQQH] H [YRGTWS
TAESGAECTNWNSSALAQKPYSGRRPDAIRLGLGNHNYCRNPDRDSKPWCYVFKAGKYSS
EFCSTPACSEGNSDCYFGNGSAYRGTHSLTESGASCLPWNSMILIGKVYTAQNPSAQALG
LGKHNYCRNPDGDAKPWCHVLKNRRLTWEYCDVPSCSTCGLRQYSQPQFRIKGGLFADIA
SHPWQAAIFAKHRRSPGERFLCGGILISSCWILSAAHCFQERFPPHHLTVILGRTYRVVP
GEEEQKFEVEKYIVHKEFDDDTYDNDIALLQLKSDSSRCAQESSVVRTVCLPPADLQLPD
WTECELSGYGKHEALSPFYSERLKEAHVRLYPSSRCTSQHLLNRTVTDNMLCAGDTRSGG
PQANLHDACQGDSGGPLVCLNDGRMTLVGIISWGLGCGQKDVPGVYTKVTNYLDWIRDNM
RP

Figure 82c

>HUMUPAA_R56 (T9) NEW EDGE ] [

ATAAAAACAGGCCTGCCTCAGCTCCCTCATGGCCCTGTCCACTGAGCATCCTCCCGCCAC
ACAGAAACCCGCCCAGCCGGGGCCACCGACCCCACCCCTGCCTGGAAACTTAAAGGAGG
CCGGAGCTGTGGGAGCTCAGAGCTGAGATCCTACAGGAGTCCAGGGCTGGAGAGAAAAC
CTCTGCGAGGAAAGGGAAGGAGCAAGCCGTGAATTTAAGGGACGCTGTGAAGCAATCATG
GATGCAATGAAGAGAGGGCTCTGCTGTGTGCTGCTGCTGTGTGGAGCAGTCTTCGTTTCG
CCCAGCCAGGAAATCCATGCCCGATTCAGAAGAGGAGCCAGATCTTACCAAGTGATCTGC
AGAGATGAAAAAACGCAGATGATATACCAGCAACATCAGTCATGGCTGCGCCCTGTGCTC
AGAAGCAACCGGGTGGAATATTGCTGGTGCAACAGTGGCAGGGCACAGTGCCACTCAGTG
CCTGTCAAAAGTTGCAGCGAGCCAAGGTGTTTCAACGGGGCACCTGCCAGCAGGCCCTG
TACTTCAGATTTCGTGTGCCAGTGCCCCGAAGGATTTGCTGGGAAGTGCTGTGAAATA
GATACCAGGGCCACGTGCTACGAGGACCAGGGCATCAGCTACAGGGGCACGTGGAGCACA
GCGGAGAGTGGCGCCGAGTGCACCAACTGGAACAGCAGCGCGTTGGCCCAGAAGCCCTAC
AGCGGGCGGAGGCCAGACGCCATCAGGCTGGGCCTGGGGAACCACAACTACTG ] [ CAGAACC
CCAGTGCCCAGGCACTGGGCCTGGGCAAACATAATTACTGCCGGAATCCTGATGGGGATG
CCAAGCCCTGGTGCCACGTGCTGAAGAACCGCAGGCTGACGTGGGAGTACTGTGATGTGC
CCTCCTGCTCCACCTGCGGCCTGAGACAGTACAGCCAGCCTCAGTTTCGCATCAAAGGAG
GGCTCTTCGCCGACATCGCCTCCCACCCCTGGCAGGCTGCCATCTTTGCCAAGCACAGGA
GGTCGCCCGGAGAGCGGTTCCTGTGCGGGGCATACTCATCAGCTCCTGCTGGATTCTCT
CTGCCGCCCACTGCTTCCAGGAGAGGTTTCCGCCCCACCACCTGACGGTGATCTTGGGCA
GAACATACCGGGTGGTCCCTGGCGAGGAGGAGCAGAAATTTGAAGTCGAAAAATACATTG
TCCATAAGGAATTCGATGATGACACTTACGACAATGACATTGCGCTGCTGCAGCTGAAAT
CGGATTCGTCCCGCTGTGCCCAGGAGAGCAGCGTGGTCCGCACTGTGTGCCTTCCCCGG
CGGACCTGCAGCTGCCGGACTGGACGGAGTGTGAGCTCTCCGGCTACGGCAAGCATGAGG
CCTTGTCTCCTTTCTATTCGGAGCGGCTGAAGGAGGCTCATGTCAGACTGTACCCATCCA
GCCGCTGCACATCACAACATTTACTTAACAGAACAGTCACCGACAACATGCTGTGTGCTG
GAGACACTCGGAGCGGCGGGCCCCAGGCAAACTTGCACGACGCCTGCCAGGGCGATTCGG
GAGGCCCCCTGGTGTGTCTGAACGATGGCCGCATGACTTTGGTGGGCATCATCAGCTGGG
GCCTGGGCTGTGGACAGAAGGATGTCCCGGGTGTGTACACCAAGGTTACCAACTACCTAG
ACTGGATTCGTGACAACATGCGACCGTGACCAGGAACACCCGACTCCTCAAAAGCAAATG
AGATCCCGCCTCTTCTTCTTCAGAAGACACTGCAAAGGCGCAGTGCTTCTCTACAGACTT
CTCCAGACCCACCACACCGCAGAAGCGGGACGAGACCCTACAGGAGAGGGAAGAGTGCAT
TTTCCCAGATACTTCCCATTTTGGAAGTTTTCAGGACTTGGTCTGATTTCAGGATACTCT
GTCAGATGGGAAGACATGAATGCACACTAGCCTCTCCAGGAATGCCTCCTCCCTGGGCAG
AAAGTGGCCATGCCACCCTGTTTTCAGCTAAAGCCCAACCTCCTGACCTGTCACCGTGAG
CAGCTTTGGAAACAGGACCACAAAAATGAAAGCATGTCTCAATAGTAAAAGATAACAAGA
TCTTTCAGGAAAGACGGATTGCATTAGAAATAGACAGTATATTTATAGTCACAAGAGCCC
AGCAGGGCCTCAAAGTTGGGGCAGGCTGGCTGGCCCGTCATGTTCCTCAAAAGCACCCTT
GACGTCAAGTCTCCTTCCCCTTTCCCCACTCCCTGGCTCTCAGAAGGTATTCCTTTTGTG
TACAGTGTGTAAAGTGTAAATCCTTTTTCTTTATAAACTTTAGAGTAGCATGAGAGAATT
GTATCATTTGAACAACTAGGCTTCAGCATATTTATAGCAATCCATGTTAGTTTTTACTTT
CTGTTGCCACAACCCTGTTTTATACTGTACTTAATAAATTCAGATATATTTTTCACAGTT
TTTCCA

Figure 82d

```
>HUMUPAA_X24
MDAMKRGLCCVLLLCGAVFVSPSQEIHARFRRGARSYQVICRDEKTQMIYQQHQSWLRPV
LRSNRVEYCWCNSGRAQCHSVPVKSCSEPRCFNGGTCQQALYFSDFVCQCPEGFAGKCCE
IDTRATCYEDQGISYRGTWSTAESGAECTNWNSSALAQKPYSGRRPDAIRLGLGNHNYCR
TPVPRHWAWANIITAGILMGMPSPGATC
```

Figure 84a

Alignment of the splice variant of t-PA T6 (HUMUPAA_P4 - SEQ ID NO:113) to the wild type protein TPA_HUMAN (SEQ ID NO:150)

```
  1 MDAMKRGLCCVLLLCGAVFVSPSQEIHARFRRGARSYQVICRDEKTQMIY  50
    ||||||||||||||||||||||||||||||||||||||||||||||||||
  1 MDAMKRGLCCVLLLCGAVFVSPSQEIHARFRRGARSYQVICRDEKTQMIY  50

51 QQHH..............................................  54
    ||||
 51 QQHQSWLRPVLRSNRVEYCWCNSGRAQCHSVPVKSCSEPRCFNGGTCQQA 100

55 ................................YRGTWSTAESGAECTN  70
                                    |||||||||||||||||
101 LYFSDFVCQCPEGFAGKCCEIDTRATCYEDQGISYRGTWSTAESGAECTN 150

71 WNSSALAQKPYSGRRPDAIRLGLGNHNYCRNPDRDSKPWCYVFKAGKYSS 120
    ||||||||||||||||||||||||||||||||||||||||||||||||||
151 WNSSALAQKPYSGRRPDAIRLGLGNHNYCRNPDRDSKPWCYVFKAGKYSS 200

121 EFCSTPACSEGNSDCYFGNGSAYRGTHSLTESGASCLPWNSMILIGKVYT 170
    ||||||||||||||||||||||||||||||||||||||||||||||||||
201 EFCSTPACSEGNSDCYFGNGSAYRGTHSLTESGASCLPWNSMILIGKVYT 250

171 AQNPSAQALGLGKHNYCRNPDGDAKPWCHVLKNRRLTWEYCDVPSCSTCG 220
    ||||||||||||||||||||||||||||||||||||||||||||||||||
251 AQNPSAQALGLGKHNYCRNPDGDAKPWCHVLKNRRLTWEYCDVPSCSTCG 300

221 LRQYSQPQFRIKGGLFADIASHPWQAAIFAKHRRSPGERFLCGGILISSC 270
    ||||||||||||||||||||||||||||||||||||||||||||||||||
301 LRQYSQPQFRIKGGLFADIASHPWQAAIFAKHRRSPGERFLCGGILISSC 350

271 WILSAAHCFQERFPPHHLTVILGRTYRVVPGEEEQKFEVEKYIVHKEFDD 320
    ||||||||||||||||||||||||||||||||||||||||||||||||||
351 WILSAAHCFQERFPPHHLTVILGRTYRVVPGEEEQKFEVEKYIVHKEFDD 400

321 DTYDNDIALLQLKSDSSRCAQESSVVRTVCLPPADLQLPDWTECELSGYG 370
    ||||||||||||||||||||||||||||||||||||||||||||||||||
401 DTYDNDIALLQLKSDSSRCAQESSVVRTVCLPPADLQLPDWTECELSGYG 450

371 KHEALSPFYSERLKEAHVRLYPSSRCTSQHLLNRTVTDNMLCAGDTRSGG 420
    ||||||||||||||||||||||||||||||||||||||||||||||||||
451 KHEALSPFYSERLKEAHVRLYPSSRCTSQHLLNRTVTDNMLCAGDTRSGG 500

421 PQANLHDACQGDSGGPLVCLNDGRMTLVGIISWGLGCGQKDVPGVYTKVT 470
    ||||||||||||||||||||||||||||||||||||||||||||||||||
501 PQANLHDACQGDSGGPLVCLNDGRMTLVGIISWGLGCGQKDVPGVYTKVT 550

471 NYLDWIRDNMRP                                      482
    ||||||||||||
551 NYLDWIRDNMRP                                      562
```

Figure 84b

Alignment of the splice variant of t-PA T9 HUMUPAA_X24 (SEQ ID
NO:115) to the wild type protein TPA_HUMAN (SEQ ID NO:150)

```
  1 MDAMKRGLCCVLLLCGAVFVSPSQEIHARFRRGARSYQVICRDEKTQMIY  50
    ||||||||||||||||||||||||||||||||||||||||||||||||||
  1 MDAMKRGLCCVLLLCGAVFVSPSQEIHARFRRGARSYQVICRDEKTQMIY  50

51 QQHQSWLRPVLRSNRVEYCWCNSGRAQCHSVPVKSCSEPRCFNGGTCQQA 100
    ||||||||||||||||||||||||||||||||||||||||||||||||||
 51 QQHQSWLRPVLRSNRVEYCWCNSGRAQCHSVPVKSCSEPRCFNGGTCQQA 100

101 LYFSDFVCQCPEGFAGKCCEIDTRATCYEDQGISYRGTWSTAESGAECTN 150
    ||||||||||||||||||||||||||||||||||||||||||||||||||
101 LYFSDFVCQCPEGFAGKCCEIDTRATCYEDQGISYRGTWSTAESGAECTN 150

151 WNSSALAQKPYSGRRPDAIRLGLGNHNYCRTPVPRHWAWANIITAGILMG 200
    |||||||||||||||||||||||||||||
151 WNSSALAQKPYSGRRPDAIRLGLGNHNYCR.................... 180

201 MPSPGATC                                          208

180 ........                                          180
```

Figure 85 t-PA structure

W.T: P | Finger | EGF | Kringle 1 | Kringle 2 | Serine protease
39-81 | 82-120 | 127-208 | 215-296 | 311-562

T6: P | F | K1 | Kringle 2 | Serine protease
39-54 | 135-208 | 215-296 | 311-562
1 unique a.a

T9: P | Finger | EGF | K1
39-81 | 82-120 | 127-179
28 unique a.a

Figure 86a

>HSU11025_T8 #LN 1780 (SEQ ID NO: 119) NEW EDGE ] [

TCTTCCTACCCATCTGCTCCCCAGAGGGCTGCCTGCTGTGCACTTGGGTCCTGGAGCCCTTCTCCACCC
GGATAGATTCCTCACCCTTGGCCCGCCTTTGCCCCACCCTACTCTGCCCAGAAGTGCAAGAGCCTAAGC
CGCCTCCATGGCCCCAGGAAGGATTCAGGGGAGAGGCCCCAAACAGGGAGCCACGCCAGCCAGACACCC
CGGCCAGAATGGAGCTGACTGAATTGCTCCTCGTGGTCATGCTTCTCCTAACTGCAAGGCTAACGCTGT
CCAGCCCGGCTCCTCCTGCTTGTGACCTCCGAGTCCTCAGTAAACTGCTTCGTGACTCCCATGTCCTTC
ACAGCAGACTGAGCCAGTGCCCAGAGGTTCACCCTTTGCCTACACCTGTCCTGCTGCCTGCTGTGGACT
TTAGCTTGGGAGAATGGAAAACCCAGATGGAGGAGACCAAGGCACAGGACATTCTGGGAGCAGTGACCC
TTCTGCTGGAGGGAGTGATGGCAGCACGGGGACAACTGGGACCCACTTGCCTCTCATCCCTCCTGGGGC
AGCTTTCTGGACAGGTCCGTCTCCTCCTTGGGGCCCTGCAGAGCCTCCTTGGAACCC] [AGGTGCGTTT
CCTGATGCTTGTAGGAGGGTCCACCCTCTGCGTCAGGCGGGCCCCACCCACCACAGCTGTCCCCAGCAG
AACCTCTCTAGTCCTCACACTGAACGAGCTCCCAAACAGGACTTCTGGATTGTTGGAGACAAACTTCAC
TGCCTCAGCCAGAACTACTGGCTCTGGGCTTCTGAAGTGGCAGCAGGGATTCAGAGCCAAGATTCCTGG
TCTGCTGAACCAAACCTCCAGGTCCCTGGACCAAATCCCCGGATACCTGAACAGGATACACGAACTCTT
GAATGGAACTCGTGGACTCTTTCCTGGACCCTCACGCAGGACCCTAGGAGCCCCGGACATTTCCTCAGG
AACATCAGACACAGGCTCCCTGCCACCCAACCTCCAGCCTGGATATTCTCCTTCCCCAACCCATCCTCC
TACTGGACAGTATACGCTCTTCCCTCTTCCACCCACCTTGCCCACCCCTGTGGTCCAGCTCCACCCCCT
GCTTCCTGACCCTTCTGCTCCAACGCCCACCCCTACCAGCCCTCTTCTAAACACATCCTACACCCACTC
CCAGAATCTGTCTCAGGAAGGGTAAGGTTCTCAGACACTGCCGACATCAGCATTGTCTCGTGTACAGCT
CCCTTCCCTGCAGGGCGCCCCTGGGAGACAACTGGACAAGATTTCCTACTTTCTCCTGAAACCCAAAGC
CCTGGTAAAAGGGATACACAGGACTGAAAAGGGAATCATTTTTCACTGTACATTATAAACCTTCAGAAG
CTATTTTTTTAAGCTATCAGCAATACTCATCAGAGCAGCTAGCTCTTTGGTCTATTTTCTGCAGAAATT
TGCAACTCACTGATTCTCTACATGCTCTTTTTCTGTGATAACTCTGCAAAGGCCTGGGCTGGCCTGGCA
GTTGAACAGAGGGAGAGACTAACCTTGAGTCAGAAAACAGAGAAAGGGTAATTTCCTTTGCTTCAAATT
CAAGGCCTTCCAACGCCCCATCCCCTTTACTATCATTCTCAGTGGGACTCTGATCCCATATTCTTAAC
AGATCTTTACTCTTGAGAAATGAATAAGCTTTCTCTCAGAAATGCTGTCCCTATACACTAGACAAAACT
GAGCCTGTATAAGGAATAAATGGGAGCGCCGAAAGCTCCCTAAAAAGCAAGGGAAA

Figure 86b

>HSU11025_P6 (SEQ ID NO:118) NEW EDGE ][

MELTELLLVVMLLLTARLTLSSPAPPACDLRVLSKLLRDSHVLHSRLSQCPEVHPLPTPVLLPAVDFSL
GEWKTQMEETKAQDILGAVTLLLEGVMAARGQLGPTCLSSLLGQLSGQVRLLLGALQSLLGTQ] [VRFL
MLVGGSTLCVRRAPPTTAVPSRTSLVLTLNELPNRTSGLLETNFTASARTTGSGLLKWQQGFRAKIPGL
LNQTSRSLDQIPGYLNRIHELLNGTRGLFPGPSRRTLGAPDISSGTSDTGSLPPNLQPGYSPSPTHPPT
GQYTLFPLPPTLPTPVVQLHPLLPDPSAPTPTPTSPLLNTSYTHSQNLSQEG

Figure 88

Alignment of the Thrombopoietin splice variant T8 (HSU11025_P6 SEQ ID NO:118) to the wild type protein TPO_HUMAN (SEQ ID NO:151)

```
  1 MELTELLLVVMLLLTARLTLSSPAPPACDLRVLSKLLRDSHVLHSRLSQC  50
    ||||||||||||||||||||||||||||||||||||||||||||||||||
  1 MELTELLLVVMLLLTARLTLSSPAPPACDLRVLSKLLRDSHVLHSRLSQC  50

51 PEVHPLPTPVLLPAVDFSLGEWKTQMEETKAQDILGAVTLLLEGVMAARG 100
    ||||||||||||||||||||||||||||||||||||||||||||||||||
 51 PEVHPLPTPVLLPAVDFSLGEWKTQMEETKAQDILGAVTLLLEGVMAARG 100

101 QLGPTCLSSLLGQLSGQVRLLLGALQSLLGTQ................. 132
    |||||||||||||||||||||||||||||||
101 QLGPTCLSSLLGQLSGQVRLLLGALQSLLGTQLPPQGRTTAHKDPNAIFL 150

133 .........VRFLMLVGGSTLCVRRAPPTTAVPSRTSLVLTLNELPNRTS 173
             |||||||||||||||||||||||||||||||||||||||||
151 SFQHLLRGKVRFLMLVGGSTLCVRRAPPTTAVPSRTSLVLTLNELPNRTS 200

174 GLLETNFTASARTTGSGLLKWQQGFRAKIPGLLNQTSRSLDQIPGYLNRI 223
    ||||||||||||||||||||||||||||||||||||||||||||||||||
201 GLLETNFTASARTTGSGLLKWQQGFRAKIPGLLNQTSRSLDQIPGYLNRI 250

224 HELLNGTRGLFPGPSRRTLGAPDISSGTSDTGSLPPNLQPGYSPSPTHPP 273
    ||||||||||||||||||||||||||||||||||||||||||||||||||
251 HELLNGTRGLFPGPSRRTLGAPDISSGTSDTGSLPPNLQPGYSPSPTHPP 300

274 TGQYTLFPLPPTLPTPVVQLHPLLPDPSAPTPTPSPLLNTSYTHSQNLS  323
    ||||||||||||||||||||||||||||||||||||||||||||||||||
301 TGQYTLFPLPPTLPTPVVQLHPLLPDPSAPTPTPSPLLNTSYTHSQNLS  350

324 QEG                                               326
    |||
351 QEG                                               353
```

Figure 90

Alignment of HSU20165_P5 (SEQ ID NO:120) to BMR2_HUMAN (SEQ ID NO:152)

```
  1 MTSSLQRPWRVPWLPWTILLVSTAAASQNQERLCAFKDPYQQDLGIGESR  50
    ||||||||||||||||||||||||||||||||||||||||||||||||||
  1 MTSSLQRPWRVPWLPWTILLVSTAAASQNQERLCAFKDPYQQDLGIGESR  50

51 ISHENGTILCSKGSTCYGLWEKSKGDINLVKQGCWSHIGDPQECHYEECV 100
    ||||||||||||||||||||||||||||||||||||||||||||||||||
 51 ISHENGTILCSKGSTCYGLWEKSKGDINLVKQGCWSHIGDPQECHYEECV 100

101 VTTTPPSIQNGTYRFCCCSTDLCNVNFTENFPPPDTTPLKTGEHRVSQDG 150
    |||||||||||||||||||||||||||||||||||||
101 VTTTPPSIQNGTYRFCCCSTDLCNVNFTENFPPPDTTPL............ 139

151 LDLLTS 156
```

Figure 92

Alignment of Atrial Natriuretic peptide receptor B splice variant (SEQ ID NO:122) to ANPB_HUMAN (SEQ ID NO:153)

```
  1 MALPSLLLLVAALAGGVRPPGARNLTLAVVLPEHNLSYAWAWPRVGPAVA  50
    ||||||||||||||||||||||||||||||||||||||||||||||||||
  1 MALPSLLLLVAALAGGVRPPGARNLTLAVVLPEHNLSYAWAWPRVGPAVA  50

51 LAVEALGRALPVDLRFVSSELEGACSEYLAPLSAVDLKLYHDPDLLLGPG 100
    ||||||||||||||||||||||||||||||||||||||||||||||||||
 51 LAVEALGRALPVDLRFVSSELEGACSEYLAPLSAVDLKLYHDPDLLLGPG 100

101 CVYPAASVARFASHWRLPLLTAGAVASGFSAKNDHYRTLVRTGPSAPKLG 150
    ||||||||||||||||||||||||||||||||||||||||||||||||||
101 CVYPAASVARFASHWRLPLLTAGAVASGFSAKNDHYRTLVRTGPSAPKLG 150

151 EFVVTLHGHFNWTARAALLYLDARTDDRPHYFTIEGVFEALQGSNLSVQH 200
    ||||||||||||||||||||||||||||||||||||||||||||||||||
151 EFVVTLHGHFNWTARAALLYLDARTDDRPHYFTIEGVFEALQGSNLSVQH 200

201 QVYAREPGGPEQATHFIRANGRIVYICGPLEMLHEILLQAQRENLTNGDY 250
    ||||||||||||||||||||||||||||||||||||||||||||||||||
201 QVYAREPGGPEQATHFIRANGRIVYICGPLEMLHEILLQAQRENLTNGDY 250

251 VFFYLDVFGESLRAGPTRATGRPWQDNRTREQAQALREAFQTVLVITYRE 300
    ||||||||||||||||||||||||||||||||||||||||||||||||||
251 VFFYLDVFGESLRAGPTRATGRPWQDNRTREQAQALREAFQTVLVITYRE 300

301 PPNPEYQEFQNRLLIRAREDFGVELGPSLMNLLIAGCFYDGILLYAEVLNE 350
    ||||||||||||||||||||||||||||||||||||||||||||||||||
301 PPNPEYQEFQNRLLIRAREDFGVELGPSLMNLLIAGCFYDGILLYAEVLNE 350

351 TIQEGGTREDGLRIVEKMQGRRYHGVTGLVVMDKNNDRETDFVLWAMGDL 400
    ||||||||||||||||||||||||||||||||||||||||||||||||||
351 TIQEGGTREDGLRIVEKMQGRRYHGVTGLVVMDKNNDRETDFVLWAMGDL 400

401 DSGDFQLHFQPWQLWLWAQESPSSCLVPPAS                   431
    |||||||
401 DSGDFQ.......................                    406
```

Figure 94a

Alignment of HSICAM2_P8 (SEQ ID NO:338) to ICA2_HUMAN (SEQ ID NO:154)

```
  1 MSSFGYRTLTVALFTLICCPGSDEKVFEVHVRPKKLAVEPKGSLEVNCST 50
    ||||||||||||||||||||||||||||||||||||||||||||||||||
  1 MSSFGYRTLTVALFTLICCPGSDEKVFEVHVRPKKLAVEPKGSLEVNCST 50

51 TCNQPEVGGLETSLDKILLDEQAQWKHYLVSNISHDTVLQCHFTCS   96
    |||||||||||||| +||||||||||||||||||||||||||||||
 51 TCNQPEVGGLETSLNKILLDEQAQWKHYLVSNISHDTVLQCHFTCS   96

97 GKQESMNSNVSVYREWLCCGALLSPGTEAVSTECTQSPSVPAPGHCHRGA 146
    |||||||||||||
 97 GKQESMNSNVSVY.................................... 109

147 LPP 149

Alignment of NEW VARIANT ENCODED BY HSICAM2_T8 (SEQ ID NO:154) to ICA2_HUMAN (SEQ ID NO:335)

```
  1 MSSFGYRTLTVALFTLICCPGSDEKVFEVHVRPKKLAVEPKGSLEVNCST  50
    ||||||||||||||||||||||||||||||||||||||||||||||||||
  1 MSSFGYRTLTVALFTLICCPGSDEKVFEVHVRPKKLAVEPKGSLEVNCST  50

51 TCNQPEVGGLETSLDKILLDEQAQWKHYLVSNISHDTVLQCHFTCS      96
    |||||||||||||||+|||||||||||||||||||||||||||||
 51 TCNQPEVGGLETSLNKILLDEQAQWKHYLVSNISHDTVLQCHFTCS      96

97 GKQESMNSNVSVYLGCTISEPCPCRHLVTGNHHVCKTTTQSSLHPQLLPS 146
    |||||||||||||
 97 GKQESMNSNVSVY.................................... 109

147 SSLHWSRPGHLLPNRGTP                                 164

109 ..................                                 109
```

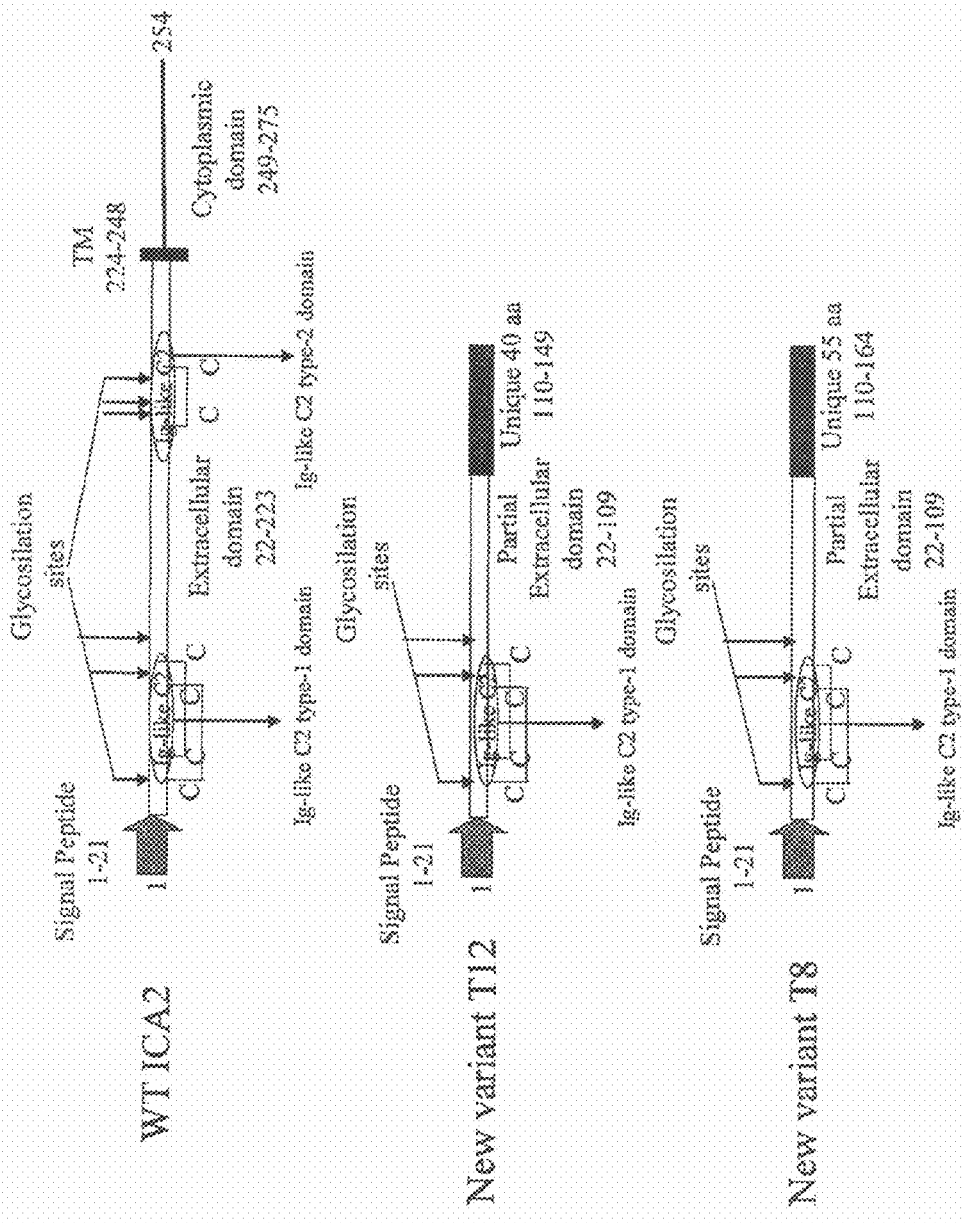

Figure 96a

>HSIFNABR_T14 (SEQ ID NO:156). SNPs position: 47 G→T; 106 C→A; 150 G→.(deletion); 387 T→G; 401 T→.(deletion); 829 T→.(deletion); 1323 G→A; 1373 A→G;

SGCCMSSGCCCCCGCGCCGGCGGCGGCGCGGCGCCCGCGCTTCCGTAGCGCTCCTCGTAG
GCCGGGGCTCGGCGCGCGCACCCGCACTAAAGACGCTTCTTCCCGGCGGGTAGGAATCCC
GCCGGCGAGCCGAACAGTTCCCCGAGCGCAGCCCGCGGACCACCACCCGGCCGCACGGGC
CGCTTTTGTCCCCCGCCCGCCGCTTCTGTCCGAGAGGCCGCCCGCGAGGCGCATCCTGAC
CGCGAGCGTCGGGTCCCAGAGCCGGGCGCGGCTGGGGCCCGAGGCTAGCATCTCTCGGGA
GCCGCAAGGCGAGAGCTGCAAAGATGTAAAAGTCAAGAGAAGACTCTAAAAATAGCAAAG
ATGCTTTTGAGCCAGAATGCCTTCATCTTCAGATCACTTAATTTGGTTCTCATGGTGTAT
ATCAGCCTCGTGTTTGGTATTTCATATGATTCGCCTGATTACACAGATGAATCTTGCACT
TTCAAGATATCATTGCGAAATTTCCGGTCCATCTTATCATGGGAATTAAAAAACCACTCC
ATTGTACCAACTCACTATACATTGCTGTATACAATCATGAGTAAACCAGAAGATTTGAAG
GTGGTTAAGAACTGTGCAAATACCACAAGATCATTTGTGACCTCACAGATGAGTGGAGA
AGCACACACGAGGCCTATGTCACCGTCCTAGAAGGATTCAGCGGGAACACAACGTTGTTC
AGTTGCTCACACAATTTCTGGCTGGCCATAGACATGTCTTTTGAACCACCAGAGTTTGAG
ATTGTTGGTTTTACCAACCACATTAATGTGATGGTGAAATTTCCATCTATTGTTGAGGAA
GAATTACAGTTTGATTTATCTCTCGTCATTGAAGAACAGTCAGAGGGAATTGTTAAGAAG
GGAGAAGATGAGAAACTAGACATCAGTCAGTTTGTCACAGACAAGCTCTGTGACCTTGG
AGAAGTTACTTAGCCACACTGAGCTACAGTTTTCTCATCCGTTGAATGGAGCATAAACCC
GAAATAAAAGGAAACATGAGTGGAAATTTCACCTATATCATTGACAAGTTAATTCCAAAC
ACGAACTACTGTGTATCTGTTTATTTAGAGCACAGTGATGAGCAAGCAGTAATAAAGTCT
CCCTTAAAATGCACCCTCCTTCCACCTGGCCAGGAATCAGAATCAGCAGAATCTGCCAAA
ATAGGAGGAATAATTACTGTGTTTTTGATAGCATTGGTCTTGACAAGCACCATAGTGACA
CTGAAATGGATTGGTTATATATGCTTAAGAAATAGCCTCCCCAAAGTCTTGAGGCAAGGT
CTCGCTAAGGGCTGGAATGCAGTGGCTATTCACAGGTGCAGTCATAATGCACTACAGTCT
GAAACTCCTGAGCTCAAACAGTCGTCCTGCCTAAGCTTCCCCAGTAGCTGGGATTACAAG
CGTGCATCCCTGTGCCCCAGTGATTAAGTTTTATTATGTAGAAAATAAAGAGCAAACAGT
ACAGCTGA

Figure 96b

>HSIFNABR_P8 (SEQ ID NO:155); Position of SNP: 10 F→V

MLLSQNAFIFRSLNLVLMVYISLVFGISYDSPDYTDESCTFKISLRNFRSILSWELKNHS
IVPTHYTLLYTIMSKPEDLKVVKNCANTTRSFCDLTDEWRSTHEAYVTVLEGFSGNTTLF
SCSHNFWLAIDMSFEPPEFEIVGFTNHINVMVKFPSIVEEELQFDLSLVIEEQSEGIVKK
GEDEKLDISQFCHRQAL

Figure 97

Alignment of HSIFNABR_P8 (SEQ ID NO:155) to INR2_HUMAN (SEQ ID NO:157)

```
  1 MLLSQNAFIFRSLNLVLMVYISLVFGISYDSPDYTDESCTFKISLRNFRS  50
    ||||||||||||||||||||||||||||||||||||||||||||||||||
  1 MLLSQNAFIFRSLNLVLMVYISLVFGISYDSPDYTDESCTFKISLRNFRS  50

51 ILSWELKNHSIVPTHYTLLYTIMSKPEDLKVVKNCANTTRSFCDLTDEWR 100
    ||||||||||||||||||||||||||||||||||||||||||||||||||
 51 ILSWELKNHSIVPTHYTLLYTIMSKPEDLKVVKNCANTTRSFCDLTDEWR 100

101 STHEAYVTVLEGFSGNTTLFSCSHNFWLAIDMSFEPPEFEIVGFTNHINV 150
    ||||||||||||||||||||||||||||||||||||||||||||||||||
101 STHEAYVTVLEGFSGNTTLFSCSHNFWLAIDMSFEPPEFEIVGFTNHINV 150

151 MVKFPSIVEEELQFDLSLVIEEQSEGIVKKGEDEKLDISQFCHRQAL     197
    |||||||||||||||||||||||||||||
151 MVKFPSIVEEELQFDLSLVIEEQSEGIVKK................     180
```

Figure 98a

>Z42185_T13 (SEQ ID NO:159)

SNPs positions: 105 G→. (deletion);
449 C→A; 552 C→T; 939 A→G; 1018 G→. (deletion); 1249 C→T
1384 C→. (deletion); 1506 G→A; 1703 C→. (deletion); 1710 A→G
1742 G→A; 1749 G→A; 1945 G→. (deletion); 1947 C→G; 2014 G→.
(deletion); 2029 G→. (deletion)

```
GGGAGCGAGGCCGTCACGAGGGACTCACTGGTGCCTGCCTTGGGGCTCCGGGACTGTGGG
CTGTCTCCATCCGGAGGTCTCCCTACCACCAGGCTCTGTGGGGCAGGGAAGCCCAGTGGG
GTGCAGGGAGCCAGGAAGCTGGGGTGGGGTCAGGGCAGGGTCCACAGGGAGACCGGGCGA
GGCTGGCAGCCTTCCCAGTCCGCGCAGCGTCTCTGCAGGGGGAGCAAGAGCTGCCCTTCC
ACCCCTCCCAGGGGACGGGTAGGGGCACTCTGGGCTTTTCCCACCCCCTCACGCAGGGAC
ACAGGCCTGGTGGGTCTATGACTGAAATTGGCCAGACCGCATTCTGGTGGTTTTATTCGG
AAGGGAAGTTTACCCTGTTCAGCAGAAGCTGAGATGGGAACAGGAAACCCACAGGGCCCC
TTTATTCGGCAAAAATGTCAGTCAGCGCCCCGGGGAGCAGCCGAGGGTCCCTGAGTGTGT
GAGTGAGGTGGGGAAACACAGATGGACTTTGGGGGGCTCCCCCTTCTACAGGAAACCCGG
AGTGGACTGGAACGGTGCAGGGGGAGAACTCGCCCCTCCCATCGGGCGCCTCCTTCATAC
CGGCCCTTCCCCTCGGCTTTGCCTGGACAGCTCCTGCCTCCCGCAGGGCCCACCTGTGTC
CCCCAGCGCCGCTCCACCCAGCAGGCCTGAGCCCCTCTCTGCTGCCAGACACCCCCTGCT
GCCCACTCTCCTGCTGCTCGGGTTCTGAGGCACAGCTTGTCACACCGAGGCGGATTCTCT
TTCTCTTTCTCTTTCTCTTCTGGCCCACAGCCGCAGCAATGGCGCTGAGTTCCTCTGCTG
GAGTTCATCCTGCTAGCTGGGTTCCCGAGCTGCCGGTCTGAGCCTGAGGCATGGAGCCTC
CTGGAGACTGGGGGCCTCCTCCCTGGAGATCCACCCCCAAAACCGACGTCTTGAGGCTGG
TGCTGTATCTCACCTTCCTGGGAGCCCCCTGCTACGCCCAGCTCTGCCGTCCTGCAAGG
AGGACGAGTACCCAGTGGGCTCCGAGTGCTGCCCCAAGTGCAGTCCAGGTTATCGTGTGA
AGGAGGCCTGCGGGGAGCTGACGGGCACAGTGTGTGAACCCTGCCCTCCAGGCACCTACA
TTGCCCACCTCAATGGCCTAAGCAAGTGTCTGCAGTGCCAAATGTGTGACCCAGCCATGG
GCCTGCGCGCGAGCCGGAACTGCTCCAGGACAGAGAACGCCGTGTGTGGCTGCAGCCCAG
GCCACTTCTGCATCGTCCAGGACGGGGACCACTGCGCCGCGTGCCGCGCTTACGCCACCT
CCAGCCCGGGCCAGAGGGTGCAGAAGGGAGGCACCGAGAGTCAGGACACCCTGTGTCAGA
ACTGCCCCCGGGGACCTTCTCTCCCAATGGGACCCTGGAGGAATGTCAGCACCAGACCA
ATTGGCCTAATCATATGTGTGAAAAGAAGAAAGCCAAGGGGTGATGTAGTCAAGGTGATC
GTCTCCGTCCAGCGGAAAAGACAGGAGGCAGAAGGTGAGGCCACAGTCATTGAGGCCCTG
CAGGCCCCTCCGGACGTCACCACGGTGGCCGTGGAGGAGACAATACCCTCATTCACGGGG
AGGAGCCCAAACCACTGACCCACAGACTCTGCACCCCGACGCCAGAGATACCTGGAGCGA
CGGCTGCTGAAAGAGGCTGTCCACCTGGCGAAACCACCGGAGCCCGGAGGCTTGGGGGCT
CCGCCCTGGGCTGGCTTCCGTCTCCTCCAGTGGAGGGAGAGGTGGGGCCCCTGCTGGGGT
AGAGCTGGGGACGCCACGTGCCATTCCCATGGGCCAGTGAGGGCCTGGGGCCTCTGTTCT
GCTGTGGCCTGAGCTCCCCAGAGTCCTGAGGAGGAGCGCCAGTTGCCCCTCGCTCACAGA
CCACACACCCAGCCCTCCTGGGCCAGCCCAGAGGGCCCTTCAGACCCCAGCTGTCTGCGC
GTCTGACTCTTGTGGCCTCAGCAGGACAGGCCCCGGGCACTGCCTCACAGCCAAGGCTGG
ACTGGGTTGGCTGCAGTGTGGTGTTTAGTGGATACCACATCGGAAGTGATTTTCTAAATT
GGATTTGAATTCGGCTCCTGTTTTCTATTTGTCATGAAACAGTGTATTTGGGGAGATGCT
GTGGGAGGATGTAAATATCTTGTTTCTCCTCAAACTGTCACCTCC
```

Figure 98b

>Z42185_P5 (SEQ ID NO:160) SNP position:17 K→R

MEPPGDWGPPPWRSTPKTDVLRLVLYLTFLGAPCYAPALPSCKEDEYPVGSECCPKCSPG
YRVKEACGELTGTVCEPCPPGTYIAHLNGLSKCLQCQMCDPAMGLRASRNCSRTENAVCG
CSPGHFCIVQDGDHCAACRAYATSSPGQRVQKGGTESQDTLCQNCPPGTFSPNGTLEECQ
HQTNWPNHMCEKKKAKG

Figure 99

Alignment of Z42185_P5 (SEQ ID NO:160) to TR14_HUMAN (SEQ ID NO:161)

```
  1 MEPPGDWGPPPWRSTPKTDVLRLVLYLTFLGAPCYAPALPSCKEDEYPVG  50
    |||||||||||||||||||||||||||||||||||||||||||||||||
  1 MEPPGDWGPPPWRSTPKTDVLRLVLYLTFLGAPCYAPALPSCKEDEYPVG  50

51 SECCPKCSPGYRVKEACGELTGTVCEPCPPGTYIAHLNGLSKCLQCQMCD 100
    |||||||||||||||||||||||||||||||||||||||||||||||||
 51 SECCPKCSPGYRVKEACGELTGTVCEPCPPGTYIAHLNGLSKCLQCQMCD 100

101 PAMGLRASRNCSRTENAVCGCSPGHFCIVQDGDHCAACRAYATSSPGQRV 150
    |||||||||||||||||||||||||||||||||||||||||||||||||
101 PAMGLRASRNCSRTENAVCGCSPGHFCIVQDGDHCAACRAYATSSPGQRV 150

151 QKGGTESQDTLCQNCPPGTFSPNGTLEECQHQTNWPNHMCEKKKAKG     197
    ||||||||||||||||||||||||||||||||||
151 QKGGTESQDTLCQNCPPGTFSPNGTLEECQHQT..............    183
```

Figure 100a

>HUMLAP_T18 (SEQ ID NO:163) SNPs positions : 302 C→T; 390 A→C; 436 G→T; 529 G→A;

ATCCAGGGTGAGGAAGGCAGCCCACACTTTTCTTGGAGACACATCCCCAAAGAMGTCCTC
ACGTGGCTCCGTTTGGGCAGAAACCATGAATTGAACGGGAAAAGAAATATGTCAAGTATC
AGAAAGAAGAGTGGCATGCTTTGACAGCAAGTGGACTCCGAGTCCAGGGCAGAGCCTCAG
GGGCCGCTCTCTGACATCAGAGCTGCTGTAGAGCGGAGAGGGGCAGGGGTGAAGGGCCAC
GGTGGTGCAACCCACCACTTCCTCCAAGGAGGAGCTGAGAGGAACAGGAAGTGTCAGGAC
TTCACGACCCGCGCCTCCAGCTGAGGTTTCTAGACGTGACCCAGGGCAGACTGGTAGCAA
AGCCCCCACGCCCAGCCAGGAGCACCGCCGAGGACTCCAGCACACCGAGGGACATGCTGG
GCCTGCGCCCCCACTGCTCGCCCTGGTGGGGCTGCTCTCCCTCGGGTGCGTCCTCTCTC
AGGAGTGCACGAAGTTCAAGGTCAGCAGCTGCCGGGAATGCATCGAGTCGGGCCCGGCT
GCACCTGGTGCCAGAAGCTGGGAGCGGCTTTGGGTCCTCCAGCCCACGCCACCGCGGCGA
GCAGTCCCCGGAGGAGAAGCCGGGTGGCTCCCGTCTGTCCTCGGACTGAGCAGGGTGGCC
AGGCCCCAGGTGGAAACTACCTTGGTCAGGCTGGGTTTTTCCCTCCCCTTTCTGGAGGT
TTTCAGCTCCTCTGAAATAAACACCTTTCAGTGAGAAAA

Figure 100b

>HUMLAP_P15 (SEQ ID NO:164)

MLGLRPPLLALVGLLSLGCVLSQECTKFKVSSCRECIESGPGCTWCQKLGAALGPPAHAT
AASSPRRRSRVAPVCPRTEQGGQAPGGNYLGQAGFFPSPFWRFSAPLK

Figure 101

Alignment of HUMLAP_P15 (SEQ ID NO:164) to ITB2_HUMAN (SEQ ID NO:165)

```
  1 MLGLRPPLLALVGLLSLGCVLSQECTKFKVSSCRECIESGPGCTWCQKLG  50
    ||||||||||||||||||||||||||||||||||||||||||||||||
  1 MLGLRPPLLALVGLLSLGCVLSQECTKFKVSSCRECIESGPGCTWCQKL.  49

51 AALGPPAHATAASSPRRRSRVAPVCPRTEQGGQAPGGNYLGQAGFFPSPF 100

49 ..................................................  49

101 WRFSAPLK                                            108

Alignment of HUMLAP_P12 (SEQ ID NO:168) to ITB2_HUMAN (SEQ ID NO:165)

```
  1 MLGLRPPLLALVGLLSLGCVLSQECTKFKVSSCRECIESGPGCTWCQKLN  50
    ||||||||||||||||||||||||||||||||||||||||||||||||||
  1 MLGLRPPLLALVGLLSLGCVLSQECTKFKVSSCRECIESGPGCTWCQKLN  50

51 FTGPGDPDSIRCDTRPQLLMRGCAADDIMDPTSLAETQEDHNGGQKQLSP 100
    ||||||||||||||||||||||||||||||||||||||||||||||||||
 51 FTGPGDPDSIRCDTRPQLLMRGCAADDIMDPTSLAETQEDHNGGQKQLSP 100

101 QKVTLYLRPGQAAAFNVTFRRAKGYPIDLYYLMDLSYSMLDDLRNVKKLG 150
    ||||||||||||||||||||||||||||||||||||||||||||||||||
101 QKVTLYLRPGQAAAFNVTFRRAKGYPIDLYYLMDLSYSMLDDLRNVKKLG 150

151 GDLLRALNEITESGRIGFGSFVDKTVLPFVNTHPDKLRNPCPNKEKECQP 200
    ||||||||||||||||||||||||||||||||||||||||||||||||||
151 GDLLRALNEITESGRIGFGSFVDKTVLPFVNTHPDKLRNPCPNKEKECQP 200

201 PFAFRHVLKLTNNSNQFSALKMTAMAGRVLLGARRGDSSTLTGTVFAWRL 250
    |||||||||||||||||
201 PFAFRHVLKLTNNSNQF................................ 217

251 EEGGLEVGEVRCVFPVQVRTSV                            272

Alignment of HUMGCRFC_P3 (SEQ ID NO:171) to FC3A_HUMAN (SEQ ID NO:173)

```
  1 MWQLLLPTALLLLVSAGMRTEDLPKAVVFLEPQWYRVLEKDSVTLKCQGA  50
    ||||||||||||||||||||||||||||||||||||||||||||||||||
  1 MWQLLLPTALLLLVSAGMRTEDLPKAVVFLEPQWYRVLEKDSVTLKCQGA  50

51 YSPEDNSTQWFHNESLISSQASSYFIDAATVDDSGEYRCQTNLSTLSDPV 100
    ||||||||||||||||||||||||||||||||||||||||||||||||||
 51 YSPEDNSTQWFHNESLISSQASSYFIDAATVDDSGEYRCQTNLSTLSDPV 100

101 QLEVHIGELMKGKRKITNKG                              120
    |||||||
101 QLEVHIG.............                              107
```

Figure 104

Alignment of HUMGCRFC_P4 (SEQ ID NO:175) to FC3A_HUMAN (SEQ ID NO:173)

```
  1 MWQLLLPTALLLLVSAGMRTEDLPKAVVFLEPQWYRVLEKDSVTLKCQGA  50
    ||||||||||||||||||||||||||||||||||||||||||||||||||
  1 MWQLLLPTALLLLVSAGMRTEDLPKAVVFLEPQWYRVLEKDSVTLKCQGA  50

51 YSPEDNSTQWFHNESLISSQASSYFIDAATVDDSGEYRCQTNLSTLSDPV 100
    ||||||||||||||||||||||||||||||||||||||||||||||||||
 51 YSPEDNSTQWFHNESLISSQASSYFIDAATVDDSGEYRCQTNLSTLSDPV 100

101 QLEVHIGPFPTMTSCSLFVKSDYLVT                         126
    |||||||
101 QLEVHIG...........................                107
```

Figure 105

Alignment of HUMTNFRRP_P2 (SEQ ID NO:178) to TNR3_HUMAN (SEQ ID NO:129)

```
  1 MLLPWATSAPGLAWGPLVLGLFGLLAASQPQAVPPYASENQTCRDQEKEY  50
    ||||||||||||||||||||||||||||||||||||||||||||||||||
  1 MLLPWATSAPGLAWGPLVLGLFGLLAASQPQAVPPYASENQTCRDQEKEY  50

51 YEPQHRICCSRCPPGTYVSAKCSRIRDTVCATCAENSYNEHWNYLTICQL 100
    ||||||||||||||||||||||||||||||||||||||||||||||||||
 51 YEPQHRICCSRCPPGTYVSAKCSRIRDTVCATCAENSYNEHWNYLTICQL 100

101 CRPCDPVMGLEEIAPCTSKRKTQCRCQPGMFCAAWALECTHCELLSDCPP 150
    ||||||||||||||||||||||||||||||||||||||||||||||||||
101 CRPCDPVMGLEEIAPCTSKRKTQCRCQPGMFCAAWALECTHCELLSDCPP 150

151 GTEAELKDEVGKGNNHCVPCKAGHFQNTSSPSARCQPHTRCENQGLVEAA 200
    ||||||||||||||||||||||||||||||||||||||||||||||||||
151 GTEAELKDEVGKGNNHCVPCKAGHFQNTSSPSARCQPHTRCENQGLVEAA 200

201 PGTAQSDTTCKNPLEPLPPEMSEPALSKGVENLQALLYQAATGSSEASFP 250
    ||||||||||||||||||||||
201 PGTAQSDTTCKNPLEPLPPEMS............................ 222

251 TLSPL                                              255

Alignment of HSGCSFR2_P11 (SEQ ID NO:182) to GCSR_HUMAN (SEQ ID NO:183)

```
  1 MARLGNCSLTWAALIILLLPGSLEECGHISVSAPIVHLGDPITASCIIKQ  50
    ||||||||||||||||||||||||||||||||||||||||||||||||||
  1 MARLGNCSLTWAALIILLLPGSLEECGHISVSAPIVHLGDPITASCIIKQ  50

51 NCSHLDPEPQILWRLGAELQPGGRQQRLSDGTQESIITLPHLNHTQAFLS 100
    ||||||||||||||||||||||||||||||||||||||||||||||||||
 51 NCSHLDPEPQILWRLGAELQPGGRQQRLSDGTQESIITLPHLNHTQAFLS 100

101 CCLNWGNSLQILDQVELRAGYPPAIPHNLSCLMNLTTSSLICQWEPGPET 150
    ||||||||||||||||||||||||||||||||||||||||||||||||||
101 CCLNWGNSLQILDQVELRAGYPPAIPHNLSCLMNLTTSSLICQWEPGPET 150

151 HLPTSFTLKSFKSRGNCQTQGDSILDCVPKDGQSHCCIPRKHLLLYQNMG 200
    ||||||||||||||||||||||||||||||||||||||||||||||||||
151 HLPTSFTLKSFKSRGNCQTQGDSILDCVPKDGQSHCCIPRKHLLLYQNMG 200

201 IWVQAENALGTSMSPQLCLDPMDVVKLEPPMLRTMDPSPEAAPPQAGCLQ 250
    ||||||||||||||||||||||||||||||||||||||||||||||||||
201 IWVQAENALGTSMSPQLCLDPMDVVKLEPPMLRTMDPSPEAAPPQAGCLQ 250

251 LCWEPWQPGLHINQKCELRHKPQRGEASWALVGPLPLEALQYELCGLLPA 300
    ||||||||||||||||||||||||||||||||||||||||||||||||||
251 LCWEPWQPGLHINQKCELRHKPQRGEASWALVGPLPLEALQYELCGLLPA 300

301 TAYTLQIRCIRWPLPGHWSDWSPSLELRTTERAPTVRLDTWWRQRQLDPR 350
    ||||||||||||||||||||||||||||||||||||||||||||||||||
301 TAYTLQIRCIRWPLPGHWSDWSPSLELRTTERAPTVRLDTWWRQRQLDPR 350

351 TVQLFWKPVPLEEDSGRIQGYVVSWRPSGQAGAILPLCNTTELSCTFHLP 400
    ||||||||||||||||||||||||||||||||||||||||||||||||||
351 TVQLFWKPVPLEEDSGRIQGYVVSWRPSGQAGAILPLCNTTELSCTFHLP 400

401 SEAQEVALVAYNSAGTSRPTPVVFSESRGPALTRLHAMARDPHSLWVGWE 450
    ||||||||||||||||||||||||||||||||||||||||||||||||||
401 SEAQEVALVAYNSAGTSRPTPVVFSESRGPALTRLHAMARDPHSLWVGWE 450

451 PPNPWPQGYVIEWGLGPPSASNSNKTWRMEQNGRATGFLLKENIRPFQLY 500
    ||||||||||||||||||||||||||||||||||||||||||||||||||
451 PPNPWPQGYVIEWGLGPPSASNSNKTWRMEQNGRATGFLLKENIRPFQLY 500

501 EIIVTPLYQDTMGPSQHVYAYSQEMGLSTIRPLSRILSSLSQGSAWSPAI 550
    |||||||||||||||||||||||||
501 EIIVTPLYQDTMGPSQHVYAYSQEM......................... 525

551 RSIGNIAFLPYFQPWRGSLPIPWLTLDPYSWTEIRCWDRN            590

Alignment of HSGCSFR2_P7 (SEQ ID NO:186) to GCSR_HUMAN (SEQ ID NO:183)

```
  1 MARLGNCSLTWAALIILLLPGSLEECGHISVSAPIVHLGDPITASCIIKQ  50
    ||||||||||||||||||||||||||||||||||||||||||||||||||
  1 MARLGNCSLTWAALIILLLPGSLEECGHISVSAPIVHLGDPITASCIIKQ  50

51 NCSHLDPEPQILWRLGAELQPGGRQQRLSDGTQESIITLPHLNHTQAFLS 100
    ||||||||||||||||||||||||||||||||||||||||||||||||||
 51 NCSHLDPEPQILWRLGAELQPGGRQQRLSDGTQESIITLPHLNHTQAFLS 100

101 CCLNWGNSLQILDQVELRAGYPPAIPHNLSCLMNLTTSSLICQWEPGPET 150
    ||||||||||||||||||||||||||||||||||||||||||||||||||
101 CCLNWGNSLQILDQVELRAGYPPAIPHNLSCLMNLTTSSLICQWEPGPET 150

151 HLPTSFTLKSFKSRGNCQTQGDSILDCVPKDGQSHCCIPRKHLLLYQNMG 200
    ||||||||||||||||||||||||||||||||||||||||||||||||||
151 HLPTSFTLKSFKSRGNCQTQGDSILDCVPKDGQSHCCIPRKHLLLYQNMG 200

201 IWVQAENALGTSMSPQLCLDPMDVVKLEPPMLRTMDPSPEAAPPQAGCLQ 250
    ||||||||||||||||||||||||||||||||||||||||||||||||||
201 IWVQAENALGTSMSPQLCLDPMDVVKLEPPMLRTMDPSPEAAPPQAGCLQ 250

251 LCWEPWQPGLHINQKCELRHKPQRGEASWALVGPLPLEALQYELCGLLPA 300
    ||||||||||||||||||||||||||||||||||||||||||||||||||
251 LCWEPWQPGLHINQKCELRHKPQRGEASWALVGPLPLEALQYELCGLLPA 300

301 TAYTLQIRCIRWPLPGHWSDWSPSLELRTTERAPTVRLDTWWRQRQLDPR 350
    ||||||||||||||||||||||||||||||||||||||||||||||||||
301 TAYTLQIRCIRWPLPGHWSDWSPSLELRTTERAPTVRLDTWWRQRQLDPR 350

351 TVQLFWKPVPLEEDSGRIQGYVVSWRPSGQAGAILPLCNTTELSCTFHLP 400
    ||||||||||||||||||||||||||||||||||||||||||||||||||
351 TVQLFWKPVPLEEDSGRIQGYVVSWRPSGQAGAILPLCNTTELSCTFHLP 400

401 SEAQEVALVAYNSAGTSRPTPVVFSESRGPALTRLHAMARDPHSLWVGWE 450
    ||||||||||||||||||||||||||||||||||||||||||||||||||
401 SEAQEVALVAYNSAGTSRPTPVVFSESRGPALTRLHAMARDPHSLWVGWE 450

451 PPNPWPQGYVIEWGLGPPSASNSNKTWRMEQNGRATGFLLKENIRPFQLY 500
    ||||||||||||||||||||||||||||||||||||||||||||||||||
451 PPNPWPQGYVIEWGLGPPSASNSNKTWRMEQNGRATGFLLKENIRPFQLY 500

501 EIIVTPLYQDTMGPSQHVYAYSQEMAPSHAPELHLKHIGKTWAQLEWVPE 550
    ||||||||||||||||||||||||||||||||||||||||||||||||||
501 EIIVTPLYQDTMGPSQHVYAYSQEMAPSHAPELHLKHIGKTWAQLEWVPE 550
```

```
551 PPELGKSPLTHYTIFWTNAQNQSF.........................  574
    |||||||||||||||||||||||
551 PPELGKSPLTHYTIFWTNAQNQSFSAILNASSRGFVLHGLEPASLYHIHL  600

575 ..............................................CLC  577
                                                  |||
601 MAASQAGATNSTVLTLMTLTPEGSELHIILGLFGLLLLLTCLC         643
```

Figure 108

Alignment of HSGCSFR2_P8 (SEQ ID NO:189) to GCSR_HUMAN (SEQ ID NO:183)

```
  1 MARLGNCSLTWAALIILLLPGSLEECGHISVSAPIVHLGDPITASCIIKQ   50
    ||||||||||||||||||||||||||||||||||||||||||||||||||
  1 MARLGNCSLTWAALIILLLPGSLEECGHISVSAPIVHLGDPITASCIIKQ   50

51 NCSHLDPEPQILWRLGAELQPGGRQQRLSDGTQESIITLPHLNHTQAFLS  100
    ||||||||||||||||||||||||||||||||||||||||||||||||||
 51 NCSHLDPEPQILWRLGAELQPGGRQQRLSDGTQESIITLPHLNHTQAFLS  100

101 CCLNWGNSLQILDQVELRAGYPPAIPHNLSCLMNLTTSSLICQWEPGPET  150
    ||||||||||||||||||||||||||||||||||||||||||||||||||
101 CCLNWGNSLQILDQVELRAGYPPAIPHNLSCLMNLTTSSLICQWEPGPET  150

151 HLPTSFTLKSFKSRGNCQTQGDSILDCVPKDGQSHCCIPRKHLLLYQNMG  200
    ||||||||||||||||||||||||||||||||||||||||||||||||||
151 HLPTSFTLKSFKSRGNCQTQGDSILDCVPKDGQSHCCIPRKHLLLYQNMG  200

201 IWVQAENALGTSMSPQLCLDPMDVVKLEPPMLRTMDPSPEAAPPQAGCLQ  250
    ||||||||||||||||||||||||||||||||||||||||||||||||||
201 IWVQAENALGTSMSPQLCLDPMDVVKLEPPMLRTMDPSPEAAPPQAGCLQ  250

251 LCWEPWQPGLHINQKCELRHKPQRGEASWALVGPLPLEALQYELCGLLPA  300
    ||||||||||||||||||||||||||||||||||||||||||||||||||
251 LCWEPWQPGLHINQKCELRHKPQRGEASWALVGPLPLEALQYELCGLLPA  300

301 TAYTLQIRCIRWPLPGHWSDWSPSLELRTTERAPTVRLDTWWRQRQLDPR  350
    ||||||||||||||||||||||||||||||||||||||||||||||||||
301 TAYTLQIRCIRWPLPGHWSDWSPSLELRTTERAPTVRLDTWWRQRQLDPR  350

351 TVQLFWKPVPLEEDSGRIQGYVVSWRPSGQAGAILPLCNTTELSCTFHLP  400
    ||||||||||||||||||||||||||||||||||||||||||||||||||
351 TVQLFWKPVPLEEDSGRIQGYVVSWRPSGQAGAILPLCNTTELSCTFHLP  400

401 SEAQEVALVAYNSAGTSRPTPVVFSESRGPALTRLHAMARDPHSLWVGWE  450
    ||||||||||||||||||||||||||||||||||||||||||||||||||
401 SEAQEVALVAYNSAGTSRPTPVVFSESRGPALTRLHAMARDPHSLWVGWE  450

451 PPNPWPQGYVIEWGLGPPSASNSNKTWRMEQNGRATGFLLKENIRPFQLY  500
    ||||||||||||||||||||||||||||||||||||||||||||||||||
451 PPNPWPQGYVIEWGLGPPSASNSNKTWRMEQNGRATGFLLKENIRPFQLY  500

501 EIIVTPLYQDTMGPSQHVYAYSQEMAPSHAPELHLKHIGKTWAQLEWVPE  550
    ||||||||||||||||||||||||||||||||||||||||||||||||||
501 EIIVTPLYQDTMGPSQHVYAYSQEMAPSHAPELHLKHIGKTWAQLEWVPE  550

551 PPELGKSPLTHYTIFWTNAQNQSFCESILSSPTAPEGLEGGAQLPRRQLY  600
    |||||||||||||||||||||||||
551 PPELGKSPLTHYTIFWTNAQNQSF.........................  574

601 HPGLC                                               605

Alignment T11329_P2 (SEQ ID NO:192) to MI2B_HUMAN (SEQ ID NO:193)

```
  1 MHKKGSPILGSHTARVAGTSPPALPLLAQLPDASAEPHGPRHALRRPQQS  50

33 .................................................  33

51 PAPAGGAAAPAPGGRQPARSRWVPAPWGPRAGRGWGGRPAPTAPLNQRVY 100

33 .................................................  33

101 SSLGASVVTELRCQCLQTLQGIHLKNIQSVNVRSPGPHCAQTEVIATLKN 150
       ||||||||||||||||||||||||||||||||||||||||||||||
 34 ...GASVVTELRCQCLQTLQGIHLKNIQSVNVRSPGPHCAQTEVIATLKN  80

151 GKKACLNPASPMVQKIIEKILNKGSTN                        177
    ||||||||||||||||||||||||||
 81 GKKACLNPASPMVQKIIEKILNKGSTN                        107
```

Figure 110

Alignment of HUMEGFAA_P6 (SEQ ID NO:195) to VEGA_HUMAN (SEQ ID NO:196)

```
  1 MNFLLSWVHWSLALLLYLHHAKWSQAAPMAEGGGQNHHEVVKFMDVYQRS  50
    |||||||||||||||||||||||||||||||||||||||||||||||||
  1 MNFLLSWVHWSLALLLYLHHAKWSQAAPMAEGGGQNHHEVVKFMDVYQRS  50

51 YCHPIETLVDIFQEYPDEIEYIFKPSCVPLMRCGGCCNDEGLECVPTEES 100
    |||||||||||||||||||||||||||||||||||||||||||||||||
 51 YCHPIETLVDIFQEYPDEIEYIFKPSCVPLMRCGGCCNDEGLECVPTEES 100

101 NITMQIMRIKPHQGQHIGEMSFLQHNKCEC...................  130
    |||||||||||||||||||||||||||||
101 NITMQIMRIKPHQGQHIGEMSFLQHNKCECRPKKDRARQEKKSVRGKGKG 150

131 .........................S.....PCGPCSERRKHLFVQDPQ 149
                              |     |||||||||||||||||||
151 QKRKRKKSRYKSWSVYVGARCCLMPWSLPGPHPCGPCSERRKHLFVQDPQ 200

150 TCKCSCKNTDSRCKARQLELNERTCRCDKPRR                   181
    ||||||||||||||||||||||||||||||||
201 TCKCSCKNTDSRCKARQLELNERTCRCDKPRR                   232
```

Figure 111

Alignment of HUMEGFAA_P8 (SEQ ID NO:199) to VEGA_HUMAN (SEQ ID NO:196)

```
  1 MNFLLSWVHWSLALLLYLHHAKWSQAAPMAEGGGQNHHEVVKFMDVYQRS  50
    ||||||||||||||||||||||||||||||||||||||||||||||||||
  1 MNFLLSWVHWSLALLLYLHHAKWSQAAPMAEGGGQNHHEVVKFMDVYQRS  50

51 YCHPIETLVDIFQEYPDEIEYIFKPSCVPLMRCGGCCNDEGLECVPTEES 100
    ||||||||||||||||||||||||||||||||||||||||||||||||||
 51 YCHPIETLVDIFQEYPDEIEYIFKPSCVPLMRCGGCCNDEGLECVPTEES 100

101 NITM..............................................  104
    ||||
101 NITMQIMRIKPHQGQHIGEMSFLQHNKCECRPKKDRARQEKKSVRGKGKG 150

105 .................................................Q 105
                                                       |
151 QKRKRKKSRYKSWSVYVGARCCLMPWSLPGPHPCGPCSERRKHLFVQDPQ 200

106 TCKCSCKNTDSRCKARQLELNERTCRCDKPRR                    137
    |||||||||||||||||||||||||||||||
201 TCKCSCKNTDSRCKARQLELNERTCRCDKPRR                    232
```

Figure 112

Alignment of HUMIL1RA_P3 (SEQ ID NO:202) to IL1R_HUMAN (SEQ ID NO:203)

```
  1 MKVLLRLICFIALLISSLEADKCKEREEKIILVSSANEIDVRPCPLNPNE  50
    ||||||||||||||||||||||||||||||||||||||||||||||||||
  1 MKVLLRLICFIALLISSLEADKCKEREEKIILVSSANEIDVRPCPLNPNE  50

51 HKGTITWYKDDSKTPVSTEQASRIHQHKEKLWFVPAKVEDSGHYYCVVRN 100
    ||||||||||||||||||||||||||||||||||||||||||||||||||
 51 HKGTITWYKDDSKTPVSTEQASRIHQHKEKLWFVPAKVEDSGHYYCVVRN 100

101 SSYCLRIKISAKFVENEPNLCYNAQAIFKQKLPVAGDGGLVCPYMEFFKN 150
    ||||||||||||||||||||||||||||||||||||||||||||||||||
101 SSYCLRIKISAKFVENEPNLCYNAQAIFKQKLPVAGDGGLVCPYMEFFKN 150

151 ENNELPKLQWYKVILF                                    166
    ||||||||||||
151 ENNELPKLQWYK....                                    162
```

Alignment of: HSCR1RS_PEA_1_P13 (SEQ ID NO:261) x CR1_HUMAN_V4 (SEQ ID NO:260)

```
  1 MGASSPRSPEPVGPPAPGLPFCCGGSLLAVVVLLALPVAWGQCNAPEWLP  50
    ||||||||||||||||||||||||||||||||||||||||||||||||||
  1 MGASSPRSPEPVGPPAPGLPFCCGGSLLAVVVLLALPVAWGQCNAPEWLP  50

51 FARPTNLTDEFEFPIGTYLNYECRPGYSGRPFSIICLKNSVWTGAKDRCR 100
    ||||||||||||||||||||||||||||||||||||||||||||||||||
 51 FARPTNLTDEFEFPIGTYLNYECRPGYSGRPFSIICLKNSVWTGAKDRCR 100

101 RKSCRNPPDPVNGMVHVIKGIQFGSQIKYSCTKGYRLIGSSSATCIISGD 150
    ||||||||||||||||||||||||||||||||||||||||||||||||||
101 RKSCRNPPDPVNGMVHVIKGIQFGSQIKYSCTKGYRLIGSSSATCIISGD 150

151 TVIWDNETPICDRIPCGLPPTIT........................... 173
    |||||||||||||||||||||||
151 TVIWDNETPICDRIPCGLPPTITNGDFISTNRENFHYGSVVTYRCNPGSG 200

173 .................................................. 173

201 GRKVFELVGEPSIYCTSNDDQVGIWSGPAPQCIIPNKCTPPNVENGILVS 250

173 .................................................. 173

251 DNRSLFSLNEVVEFRCQPGFVMKGPRRVKCQALNKWEPELPSCSRVCQPP 300

173 .................................................. 173

301 PDVLHAERTQRDKDNFSPGQEVFYSCEPGYDLRGAASMRCTPQGDWSPAA 350

173 .................................................. 173

351 PTCEVKSCDDFMGQLLNGRVLFPVNLQLGAKVDFVCDEGFQLKGSSASYC 400

173 .................................................. 173

401 VLAGMESLWNSSVPVCEQIFCPSPPVIPNGRHTGKPLEVFPFGKAVNYTC 450

173 .................................................. 173

451 DPHPDRGTSFDLIGESTIRCTSDPQGNGVWSSPAPRCGILGHCQAPDHFL 500
```

501 FAKLKTQTNASDFPIGTSLKYECRPEYYGRPFSITCLDNLVWSSPKDVCK 550

173 ......................................... 173

551 RKSCKTPPDPVNGMVHVITDIQVGSRINYSCTTGHRLIGHSSAECILSGN 600

174 .....................NGDFISTNRENFHYGSVVTYRCNPGSG 200
                         |||||||||||||||||||||||||||||
 601 AAHWSTKPPICQRIPCGLPPTIANGDFISTNRENFHYGSVVTYRCNPGSG 650

201 GRKVFELVGEPSIYCTSNDDQVGIWSGPAPQCIIPNKCTPPNVENGILVS 250
     |||||||||||||||||||||||||||||||||||||||||||||||||
 651 GRKVFELVGEPSIYCTSNDDQVGIWSGPAPQCIIPNKCTPPNVENGILVS 700

251 DNRSLFSLNEVVEFRCQPGFVMKGPRRVKCQALNKWEPELPSCSRVCQPP 300
     |||||||||||||||||||||||||||||||||||||||||||||||||
 701 DNRSLFSLNEVVEFRCQPGFVMKGPRRVKCQALNKWEPELPSCSRVCQPP 750

301 PDVLHAERTQRDKDNFSPGQEVFYSCEPGYDLRGAASMRCTPQGDWSPAA 350
     |||||||||||||||||||||||||||||||||||||||||||||||||
 751 PDVLHAERTQRDKDNFSPGQEVFYSCEPGYDLRGAASMRCTPQGDWSPAA 800

351 PTCEVKSCDDFMGQLLNGRVLFPVNLQLGAKVDFVCDEGFQLKGSSASYC 400
     |||||||||||||||||||||||||||||||||||||||||||||||||
 801 PTCEVKSCDDFMGQLLNGRVLFPVNLQLGAKVDFVCDEGFQLKGSSASYC 850

401 VLAGMESLWNSSVPVCEQIFCPSPPVIPNGRHTGKPLEVFPFGKTVNYTC 450
     |||||||||||||||||||||||||||||||||||||||||||||||||
 851 VLAGMESLWNSSVPVCEQIFCPSPPVIPNGRHTGKPLEVFPFGKTVNYTC 900

451 DPHPDRGTSFDLIGESTIRCTSDPQGNGVWSSPAPRCGILGHCQAPDHFL 500
     |||||||||||||||||||||||||||||||||||||||||||||||||
 901 DPHPDRGTSFDLIGESTIRCTSDPQGNGVWSSPAPRCGILGHCQAPDHFL 950

501 FAKLKTQTNASDFPIGTSLKYECRPEYYGRPFSITCLDNLVWSSPKDVCK 550
     |||||||||||||||||||||||||||||||||||||||||||||||||
 951 FAKLKTQTNASDFPIGTSLKYECRPEYYGRPFSITCLDNLVWSSPKDVCK 1000

551 RKSCKTPPDPVNGMVHVITDIQVGSRINYSCTTGHRLIGHSSAECILSGN 600
     |||||||||||||||||||||||||||||||||||||||||||||||||
1001 RKSCKTPPDPVNGMVHVITDIQVGSRINYSCTTGHRLIGHSSAECILSGN 1050

601 TAHWSTKPPICQRIPCGLPPTIANGDFISTNRENFHYGSVVTYRCNLGSR 650
     |||||||||||||||||||||||||||||||||||||||||||||||||
1051 TAHWSTKPPICQRIPCGLPPTIANGDFISTNRENFHYGSVVTYRCNLGSR 1100

651 GRKVFELVGEPSIYCTSNDDQVGIWSGPAPQCIIPNKCTPPNVENGILVS 700
     |||||||||||||||||||||||||||||||||||||||||||||||||
1101 GRKVFELVGEPSIYCTSNDDQVGIWSGPAPQCIIPNKCTPPNVENGILVS 1150

701 DNRSLFSLNEVVEFRCQPGFVMKGPRRVKCQALNKWEPELPSCSRVCQPP 750
     |||||||||||||||||||||||||||||||||||||||||||||||||
1151 DNRSLFSLNEVVEFRCQPGFVMKGPRRVKCQALNKWEPELPSCSRVCQPP 1200

751 PEILHGEHTPSHQDNFSPGQEVFYSCEPGYDLRGAASLHCTPQGDWSPEA 800
     |||||||||||||||||||||||||||||||||||||||||||||||||
1201 PEILHGEHTPSHQDNFSPGQEVFYSCEPGYDLRGAASLHCTPQGDWSPEA 1250
```

```
 801 PRCAVKSCDDFLGQLPHGRVLFPLNLQLGAKVSFVCDEGFRLKGSSVSHC  850
     ||||||||||||||||||||||||||||||||||||||||||||||||||
1251 PRCAVKSCDDFLGQLPHGRVLFPLNLQLGAKVSFVCDEGFRLKGSSVSHC 1300

851 VLVGMRSLWNNSVPVCEHIFCPNPPAILNGRHTGTPSGDIPYGKEISYTC  900
     ||||||||||||||||||||||||||||||||||||||||||||||||||
1301 VLVGMRSLWNNSVPVCEHIFCPNPPAILNGRHTGTPSGDIPYGKEISYTC 1350

901 DPHPDRGMTFNLIGESTIRCTSDPHGNGVWSSPAPRCELSVRAGHCKTPE  950
     ||||||||||||||||||||||||||||||||||||||||||||||||||
1351 DPHPDRGMTFNLIGESTIRCTSDPHGNGVWSSPAPRCELSVRAGHCKTPE 1400

951 QFPFASPTIPINDFEFPVGTSLNYECRPGYFGKMFSISCLENLVWSSVED 1000
     ||||||||||||||||||||||||||||||||||||||||||||||||||
1401 QFPFASPTIPINDFEFPVGTSLNYECRPGYFGKMFSISCLENLVWSSVED 1450

1001 NCRRKSCGPPPEPFNGMVHINTDTQFGSTVNYSCNEGFRLIGSPSTTCLV 1050
     ||||||||||||||||||||||||||||||||||||||||||||||||||
1451 NCRRKSCGPPPEPFNGMVHINTDTQFGSTVNYSCNEGFRLIGSPSTTCLV 1500

1051 SGNNVTWDKKAPICEIISCEPPPTISNGDFYSNNRTSFHNGTVVTYQCHT 1100
     ||||||||||||||||||||||||||||||||||||||||||||||||||
1501 SGNNVTWDKKAPICEIISCEPPPTISNGDFYSNNRTSFHNGTVVTYQCHT 1550

1101 GPDGEQLFELVGERSIYCTSKDDQVGVWSSPPPRCISTNKCTAPEVENAI 1150
     ||||||||||||||||||||||||||||||||||||||||||||||||||
1551 GPDGEQLFELVGERSIYCTSKDDQVGVWSSPPPRCISTNKCTAPEVENAI 1600

1151 RVPGNRSFFSLTEIIRFRCQPGFVMVGSHTVQCQTNGRWGPKLPHCSRVC 1200
     ||||||||||||||||||||||||||||||||||||||||||||||||||
1601 RVPGNRSFFSLTEIIRFRCQPGFVMVGSHTVQCQTNGRWGPKLPHCSRVC 1650

1201 QPPPEILHGEHTLSHQDNFSPGQEVFYSCEPSYDLRGAASLHCTPQGDWS 1250
     ||||||||||||||||||||||||||||||||||||||||||||||||||
1651 QPPPEILHGEHTLSHQDNFSPGQEVFYSCEPSYDLRGAASLHCTPQGDWS 1700

1251 PEAPRCTVKSCDDFLGQLPHGRVLLPLNLQLGAKVSFVCDEGFRLKGRSA 1300
     ||||||||||||||||||||||||||||||||||||||||||||||||||
1701 PEAPRCTVKSCDDFLGQLPHGRVLLPLNLQLGAKVSFVCDEGFRLKGRSA 1750

1301 SHCVLAGMKALWNSSVPVCEQIFCPNPPAILNGRHTGTPFGDIPYGKEIS 1350
     ||||||||||||||||||||||||||||||||||||||||||||||||||
1751 SHCVLAGMKALWNSSVPVCEQIFCPNPPAILNGRHTGTPFGDIPYGKEIS 1800

1351 YACDTHPDRGMTFNLIGESSIRCTSDPQGNGVWSSPAPRCELSVPAACPH 1400
     ||||||||||||||||||||||||||||||||||||||||||||||||||
1801 YACDTHPDRGMTFNLIGESSIRCTSDPQGNGVWSSPAPRCELSVPAACPH 1850

1401 PPKIQNGHYIGGHVSLYLPGMTISYICDPGYLLVGKGFIFCTDQGIWSQL 1450
     ||||||||||||||||||||||||||||||||||||||||||||||||||
1851 PPKIQNGHYIGGHVSLYLPGMTISYICDPGYLLVGKGFIFCTDQGIWSQL 1900

1451 DHYCKEVNCSFPLFMNGISKELEMKKVYHYGDYVTLKCEDGYTLEGSPWS 1500
     ||||||||||||||||||||||||||||||||||||||||||||||||||
1901 DHYCKEVNCSFPLFMNGISKELEMKKVYHYGDYVTLKCEDGYTLEGSPWS 1950

1501 QCQADDRWDPPLAKCTSRAHDALIV                         1525
     |||||||||||||||||||||||||
1951 QCQADDRWDPPLAKCTSRAHDALIV                         1975
```

Figure 114

Alignment of: HSCR1RS_PEA_1_P14 (SEQ ID NO:262) x CR1_HUMAN (SEQ ID NO:148) ..

```
  1 MGASSPRSPEPVGPPAPGLPFCCGGSLLAVVVLLALPVAWGQCNAPEWLP  50
    ||||||||||||||||||||||||||||||||||||||||||||||||||
  1 MGASSPRSPEPVGPPAPGLPFCCGGSLLAVVVLLALPVAWGQCNAPEWLP  50

51 FARPTNLTDEFEFPIGTYLNYECRPGYSGRPFSIICLKNSVWTGAKDRCR 100
    ||||||||||||||||||||||||||||||||||||||||||||||||||
 51 FARPTNLTDEFEFPIGTYLNYECRPGYSGRPFSIICLKNSVWTGAKDRCR 100

101 RKSCRNPPDPVNGMVHVIKGIQFGSQIKYSCTKGYRLIGSSSATCIISGD 150
    ||||||||||||||||||||||||||||||||||||||||||||||||||
101 RKSCRNPPDPVNGMVHVIKGIQFGSQIKYSCTKGYRLIGSSSATCIISGD 150

151 TVIWDNETPICDRIPCGLPPTITNGDFISTNRENFHYGSVVTYRCNPGSG 200
    ||||||||||||||||||||||||||||||||||||||||||||||||||
151 TVIWDNETPICDRIPCGLPPTITNGDFISTNRENFHYGSVVTYRCNPGSG 200

201 GRKVFELVGEPSIYCTSNDDQVGIWSGPAPCIIPNKCTPPNVENGILVS 250
    ||||||||||||||||||||||||||||||||||||||||||||||||||
201 GRKVFELVGEPSIYCTSNDDQVGIWSGPAPCIIPNKCTPPNVENGILVS 250

251 DNRSLFSLNEVVEFRCQPGFVMKGPRRVKCQALNKWEPELPSCSRVCQPP 300
    ||||||||||||||||||||||||||||||||||||||||||||||||||
251 DNRSLFSLNEVVEFRCQPGFVMKGPRRVKCQALNKWEPELPSCSRVCQPP 300

301 PDVLHAERTQRDKDNFSPGQEVFYSCEPGYDLRGAASMRCTPQGDWSPAA 350
    ||||||||||||||||||||||||||||||||||||||||||||||||||
301 PDVLHAERTQRDKDNFSPGQEVFYSCEPGYDLRGAASMRCTPQGDWSPAA 350

351 PTCEVKSCDDFMGQLLNGRVLFPVNLQLGAKVDFVCDEGFQLKGSSASYC 400
    ||||||||||||||||||||||||||||||||||||||||||||||||||
351 PTCEVKSCDDFMGQLLNGRVLFPVNLQLGAKVDFVCDEGFQLKGSSASYC 400

401 VLAGMESLWNSSVPVCEQIFCPSPPVIPNGRHTGKPLEVFPFGKAVNYTC 450
    ||||||||||||||||||||||||||||||||||||||||||||||||||
401 VLAGMESLWNSSVPVCEQIFCPSPPVIPNGRHTGKPLEVFPFGKAVNYTC 450

451 DPHPDRGTSFDLIGESTIRCTSDPQGNGVWSSPAPRCGILGHCQAPDHFL 500
    ||||||||||||||||||||||||||||||||||||||||||||||||||
451 DPHPDRGTSFDLIGESTIRCTSDPQGNGVWSSPAPRCGILGHCQAPDHFL 500

501 FAKLKTQTNASDFPIGTSLKYECRPEYYGRPFSITCLDNLVWSSPKDVCK 550
    ||||||||||||||||||||||||||||||||||||||||||||||||||
501 FAKLKTQTNASDFPIGTSLKYECRPEYYGRPFSITCLDNLVWSSPKDVCK 550

551 RKSCKTPPDPVNGMVHVITDIQVGSRINYSCTTG                584
    ||||||||||||||||||||||||||||||||||
551 RKSCKTPPDPVNGMVHVITDIQVGSRINYSCTTG                584
```

Figure 115

Alignment of: HSCR1RS_PEA_1_P15 (SEQ ID NO:263) x CR1_HUMAN (SEQ ID NO:148)

```
  1 MGASSPRSPEPVGPPAPGLPFCCGGSLLAVVVLLALPVAWGQCNAPEWLP  50
    ||||||||||||||||||||||||||||||||||||||||||||||||||
  1 MGASSPRSPEPVGPPAPGLPFCCGGSLLAVVVLLALPVAWGQCNAPEWLP  50

51 FARPTNLTDEFEFPIGTYLNYECRPGYSGRPFSIICLKNSVWTGAKDRCR 100
    ||||||||||||||||||||||||||||||||||||||||||||||||||
 51 FARPTNLTDEFEFPIGTYLNYECRPGYSGRPFSIICLKNSVWTGAKDRCR 100

101 RKSCRNPPDPVNGMVHVIKGIQFGSQIKYSCTKGYRLIGSSSATCIISGD 150
    ||||||||||||||||||||||||||||||||||||||||||||||||||
101 RKSCRNPPDPVNGMVHVIKGIQFGSQIKYSCTKGYRLIGSSSATCIISGD 150

151 TVIWDNETPICD                                       162
    ||||||||||||
151 TVIWDNETPICD                                       162
```

Alignment of: HSCR1RS_PEA_1_P17 (SEQ ID NO:264) x CR1_HUMAN_V1 (SEQ ID NO:259)

```
  1 MGASSPRSPEPVGPPAPGLPFCCGGSLLAVVVLLALPVAWGQCNAPEWLP  50
    ||||||||||||||||||||||||||||||||||||||||||||||||||
  1 MGASSPRSPEPVGPPAPGLPFCCGGSLLAVVVLLALPVAWGQCNAPEWLP  50

51 FARPTNLTDEFEFPIGTYLNYECRPGYSGRPFSIICLKNSVWTGAKDRCR 100
    ||||||||||||||||||||||||||||||||||||||||||||||||||
 51 FARPTNLTDEFEFPIGTYLNYECRPGYSGRPFSIICLKNSVWTGAKDRCR 100

101 RKSCRNPPDPVNGMVHVIKGIQFGSQIKYSCTKGYRLIGSSSATCIISGD 150
    ||||||||||||||||||||||||||||||||||||||||||||||||||
101 RKSCRNPPDPVNGMVHVIKGIQFGSQIKYSCTKGYRLIGSSSATCIISGD 150

151 TVIWDNETPICDRIPCGLPPTITNGDFISTNRENFHYGSVVTYRCNPGSG 200
    ||||||||||||||||||||||||||||||||||||||||||||||||||
151 TVIWDNETPICDRIPCGLPPTITNGDFISTNRENFHYGSVVTYRCNPGSG 200

201 GRKVFELVGEPSIYCTSNDDQVGIWSGPAPQCIIPNKCTPPNVENGILVS 250
    ||||||||||||||||||||||||||||||||||||||||||||||||||
201 GRKVFELVGEPSIYCTSNDDQVGIWSGPAPQCIIPNKCTPPNVENGILVS 250

251 DNRSLFSLNEVVEFRCQPGFVMKGPRRVKCQALNKWEPELPSCSRVCQPP 300
    ||||||||||||||||||||||||||||||||||||||||||||||||||
251 DNRSLFSLNEVVEFRCQPGFVMKGPRRVKCQALNKWEPELPSCSRVCQPP 300

301 PDVLHAERTQRDKDNFSPGQEVFYSCEPGYDLRGAASMRCTPQGDWSPAA 350
    ||||||||||||||||||||||||||||||||||||||||||||||||||
301 PDVLHAERTQRDKDNFSPGQEVFYSCEPGYDLRGAASMRCTPQGDWSPAA 350

351 PTCEVKSCDDFMGQLLNGRVLFPVNLQLGAKVDFVCDEGFQLKGSSASYC 400
    ||||||||||||||||||||||||||||||||||||||||||||||||||
351 PTCEVKSCDDFMGQLLNGRVLFPVNLQLGAKVDFVCDEGFQLKGSSASYC 400

401 VLAGMESLWNSSVPVCEQIFCPSPPVIPNGRHTGKPLEVFPFGKTVNYTC 450
    |||||||||||||||||||||||||||||||||||||||||||| |||||
401 VLAGMESLWNSSVPVCEQIFCPSPPVIPNGRHTGKPLEVFPFGKAVNYTC 450

451 DPHPDRGTSFDLIGESTIRCTSDPQGNGVWSSPAPRCGILGHCQAPDHFL 500
    ||||||||||||||||||||||||||||||||||||||||||||||||||
451 DPHPDRGTSFDLIGESTIRCTSDPQGNGVWSSPAPRCGILGHCQAPDHFL 500

501 FAKLKTQTNASDFPIGTSLKYECRPEYYGRPFSITCLDNLVWSSPKDVCK 550
    ||||||||||||||||||||||||||||||||||||||||||||||||||
501 FAKLKTQTNASDFPIGTSLKYECRPEYYGRPFSITCLDNLVWSSPKDVCK 550
```

```
 551 RKSCKTPPDPVNGMVHVITDIQVGSRINYSCTTGHRLIGHSSAECILSGN  600
     ||||||||||||||||||||||||||||||||||||||||||||||||||
 551 RKSCKTPPDPVNGMVHVITDIQVGSRINYSCTTGHRLIGHSSAECILSGN  600

601 AAHWSTKPPICQRIPCGLPPTIANGDFISTNRENFHYGSVVTYRCNPGSG  650
     ||||||||||||||||||||||||||||||||||||||||||||||||||
 601 AAHWSTKPPICQRIPCGLPPTIANGDFISTNRENFHYGSVVTYRCNPGSG  650

651 GRKVFELVGEPSIYCTSNDDQVGIWSGPAPQCIIPNKCTPPNVENGILVS  700
     ||||||||||||||||||||||||||||||||||||||||||||||||||
 651 GRKVFELVGEPSIYCTSNDDQVGIWSGPAPQCIIPNKCTPPNVENGILVS  700

701 DNRSLFSLNEVVEFRCQPGFVMKGPRRVKCQALNKWEPELPSCSRVCQPP  750
     ||||||||||||||||||||||||||||||||||||||||||||||||||
 701 DNRSLFSLNEVVEFRCQPGFVMKGPRRVKCQALNKWEPELPSCSRVCQPP  750

751 PDVLHAERTQRDKDNFSPGQEVFYSCEPGYDLRGAASMRCTPQGDWSPAA  800
     ||||||||||||||||||||||||||||||||||||||||||||||||||
 751 PDVLHAERTQRDKDNFSPGQEVFYSCEPGYDLRGAASMRCTPQGDWSPAA  800

801 PTCEVKSCDDFMGQLLNGRVLFPVNLQLGAKVDFVCDEGFQLKGSSASYC  850
     ||||||||||||||||||||||||||||||||||||||||||||||||||
 801 PTCEVKSCDDFMGQLLNGRVLFPVNLQLGAKVDFVCDEGFQLKGSSASYC  850

851 VLAGMESLWNSSVPVCEQIFCPSPPVIPNGRHTGKPLEVFPFGKAVNYTC  900
     ||||||||||||||||||||||||||||||||||||||||||||||||||
 851 VLAGMESLWNSSVPVCEQIFCPSPPVIPNGRHTGKPLEVFPFGKAVNYTC  900

901 DPHPDRGTSFDLIGESTIRCTSDPQGNGVWSSPAPRCGILGHCQAPDHFL  950
     ||||||||||||||||||||||||||||||||||||||||||||||||||
 901 DPHPDRGTSFDLIGESTIRCTSDPQGNGVWSSPAPRCGILGHCQAPDHFL  950

951 FAKLKTQTNASDFPIGTSLKYECRPEYYGRPFSITCLDNLVWSSPKDVCK 1000
     ||||||||||||||||||||||||||||||||||||||||||||||||||
 951 FAKLKTQTNASDFPIGTSLKYECRPEYYGRPFSITCLDNLVWSSPKDVCK 1000

1001 RKSCKTPPDPVNGMVHVITDIQVGSRINYSCTTGHRLIGHSSAECILSGN 1050
     ||||||||||||||||||||||||||||||||||||||||||||||||||
1001 RKSCKTPPDPVNGMVHVITDIQVGSRINYSCTTGHRLIGHSSAECILSGN 1050

1051 TAHWSTKPPICQRIPCGLPPTIANGDFISTNRENFHYGSVVTYRCNLGSR 1100
     ||||||||||||||||||||||||||||||||||||||||||||||||||
1051 TAHWSTKPPICQRIPCGLPPTIANGDFISTNRENFHYGSVVTYRCNLGSR 1100

1101 GRKVFELVGEPSIYCTSNDDQVGIWSGPAPQCIIPNKCTPPNVENGILVS 1150
     ||||||||||||||||||||||||||||||||||||||||||||||||||
1101 GRKVFELVGEPSIYCTSNDDQVGIWSGPAPQCIIPNKCTPPNVENGILVS 1150

1151 DNRSLFSLNEVVEFRCQPGFVMKGPRRVKCQALNKWEPELPSCSRVCQPP 1200
     ||||||||||||||||||||||||||||||||||||||||||||||||||
1151 DNRSLFSLNEVVEFRCQPGFVMKGPRRVKCQALNKWEPELPSCSRVCQPP 1200

1201 PEILHGEHTPSHQDNFSPGQEVFYSCEPGYDLRGAASLHCTPQGDWSPEA 1250
     ||||||||||||||||||||||||||||||||||||||||||||||||||
1201 PEILHGEHTPSHQDNFSPGQEVFYSCEPGYDLRGAASLHCTPQGDWSPEA 1250

1251 PRCAVKSCDDFLGQLPHGRVLFPLNLQLGAKVSFVCDEGFRLKGSSVSHC 1300
     ||||||||||||||||||||||||||||||||||||||||||||||||||
1251 PRCAVKSCDDFLGQLPHGRVLFPLNLQLGAKVSFVCDEGFRLKGSSVSHC 1300
```

```
1301 VLVGMRSLWNNSVPVCEHIFCPNPPAILNGRHTGTPSGDIPYGKEISYTC 1350
     ||||||||||||||||||||||||||||||||||||||||||||||||||
1301 VLVGMRSLWNNSVPVCEHIFCPNPPAILNGRHTGTPSGDIPYGKEISYTC 1350

1351 DPHPDRGMTFNLIGESTIRCTSDPHGNGVWSSPAPRCELSVRAGHCKTPE 1400
     ||||||||||||||||||||||||||||||||||||||||||||||||||
1351 DPHPDRGMTFNLIGESTIRCTSDPHGNGVWSSPAPRCELSVRAGHCKTPE 1400

1401 QFPFASPTIPINDFEFPVGTSLNYECRPGYFGKMFSISCLENLVWSSVED 1450
     ||||||||||||||||||||||||||||||||||||||||||||||||||
1401 QFPFASPTIPINDFEFPVGTSLNYECRPGYFGKMFSISCLENLVWSSVED 1450

1451 NCRRKSCGPPPEPFNGMVHINTDTQFGSTVNYSCNEGFRLIGSPSTTCLV 1500
     ||||||||||||||||||||||||||||||||||||||||||||||||||
1451 NCRRKSCGPPPEPFNGMVHINTDTQFGSTVNYSCNEGFRLIGSPSTTCLV 1500

1501 SGNNVTWDKKAPICEIISCEPPPTISNGDFYSNNRTSFHNGTVVTYQCHT 1550
     ||||||||||||||||||||||||||||||||||||||||||||||||||
1501 SGNNVTWDKKAPICEIISCEPPPTISNGDFYSNNRTSFHNGTVVTYQCHT 1550

1551 GPDGEQLFELVGERSIYCTSKDDQVGVWSSPPPRCISTNKCTAPEVENAI 1600
     ||||||||||||||||||||||||||||||||||||||||||||||||||
1551 GPDGEQLFELVGERSIYCTSKDDQVGVWSSPPPRCISTNKCTAPEVENAI 1600

1601 RVPGNRSFFSLTEIIRFRCQPGFVMVGSHTVQCQTNGRWGPKLPHCSRVC 1650
     ||||||||||||||||||||||||||||||||||||||||||||||||||
1601 RVPGNRSFFSLTEIIRFRCQPGFVMVGSHTVQCQTNGRWGPKLPHCSRVC 1650

1651 QPPPEILHGEHTLSHQDNFSPGQEVFYSCEPSYDLRGAASLHCTPQGDWS 1700
     ||||||||||||||||||||||||||||||||||||||||||||||||||
1651 QPPPEILHGEHTLSHQDNFSPGQEVFYSCEPSYDLRGAASLHCTPQGDWS 1700

1701 PEAPRCTVKSCDDFLGQLPHGRVLLPLNLQLGAKVSFVCDEGFRLKGRSA 1750
     ||||||||||||||||||||||||||||||||||||||||||||||||||
1701 PEAPRCTVKSCDDFLGQLPHGRVLLPLNLQLGAKVSFVCDEGFRLKGRSA 1750

1751 SHCVLAGMKALWNSSVPVCEQIFCPNPPAILNGRHTGTPFGDIPYGKEIS 1800
     ||||||||||||||||||||||||||||||||||||||||||||||||||
1751 SHCVLAGMKALWNSSVPVCEQIFCPNPPAILNGRHTGTPFGDIPYGKEIS 1800

1801 YACDTHPDRGMTFNLIGESSIRCTSDPQGNGVWSSPAPRCELSVPAACPH 1850
     ||||||||||||||||||||||||||||||||||||||||||||||||||
1801 YACDTHPDRGMTFNLIGESSIRCTSDPQGNGVWSSPAPRCELSVPAACPH 1850

1851 PPKIQNGHYIGGHVSLYLPGMTISYICDPGYLLVGKGFIFCTDQGIWSQL 1900
     ||||||||||||||||||||||||||||||||||||||||||||||||||
1851 PPKIQNGHYIGGHVSLYLPGMTISYICDPGYLLVGKGFIFCTDQGIWSQL 1900

1901 DHYCKEVNCSFPLFMNGISKELEMKKVYHYGDYVTLKCEDGYTLEGSPWS 1950
     ||||||||||||||||||||||||||||||||||||||||||||||||||
1901 DHYCKEVNCSFPLFMNGISKELEMKKVYHYGDYVTLKCEDGYTLEGSPWS 1950

1951 QCQADDRWDPPLAKCTSRAHDALIV                         1975
     |||||||||||||||||||||||||
1951 QCQADDRWDPPLAKCTSRAHDALIV                         1975
```

Figure 117

Alignment of HSPROI1B_X1 (SEQ ID NO:270) to IL1B_HUMAN (SEQ ID NO:265) from: 1 to: 269

```
  1 MAEVPELASEMMAYYSGNEDDLFFEADGPKQMKCSFQDLDLCPLDGGIQL  50
    ||||||||||||||||||||||||||||||||||||||||||||||||||
  1 MAEVPELASEMMAYYSGNEDDLFFEADGPKQMKCSFQDLDLCPLDGGIQL  50

51 RISDHHYSKGFRQAASVVVAMDKLRKMLVPCPQTFQENDLSTFFPFIFEE 100
    ||||||||||||||||||||||||||||||||||||||||||||||||||
 51 RISDHHYSKGFRQAASVVVAMDKLRKMLVPCPQTFQENDLSTFFPFIFEE 100

101 EPIFFDTWDNEAYVHDAPVRSLNCTLRDSQQKSLVMSGPYELKALHLQGQ 150
    ||||||||||||||||||||||||||||||||||||||||||||||||||
101 EPIFFDTWDNEAYVHDAPVRSLNCTLRDSQQKSLVMSGPYELKALHLQGQ 150

151 DMEQQVVFSMSFVQGEESNDKIPVALGLKEKNLYLSCVLKDDKPTLQLEV 200
    |||||||||||||||||||||||||||||||||||||||||||||||
151 DMEQQVVFSMSFVQGEESNDKIPVALGLKEKNLYLSCVLKDDKPTLQLES 200

201 SECYGMKPFSASCYHLFPDNHLLPAPIPRKSWEQVYL 237
      :            | |:       |:|: |:  ::
201 VD..............PKNY......PKKKMEKRFV 216
```

Figure 118

Alignment of HUMPDGFR_P6 (SEQ ID NO :272) to PGDR_HUMAN (SEQ ID NO :267)

```
  1 MRLPGAMPALALKGELLLLSLLLLLEPQISQGLVVTPPGPELVLNVSSTF  50
    |||||||||||||||||||||||||||||||||||||||||||||||||
  1 MRLPGAMPALALKGELLLLSLLLLLEPQISQGLVVTPPGPELVLNVSSTF  50

51 VLTCSGSAPVVWERMSQEPPQEMAKAQDGTFSSVLTLTNLTGLDTGEYFC 100
    |||||||||||||||||||||||||||||||||||||||||||||||||
 51 VLTCSGSAPVVWERMSQEPPQEMAKAQDGTFSSVLTLTNLTGLDTGEYFC 100

101 THNDSRGLETDERKRLYIFVPDPTVGFLPNDAEELFIFLTEITEITIPCR 150
    |||||||||||||||||||||||||||||||||||||||||||||||||
101 THNDSRGLETDERKRLYIFVPDPTVGFLPNDAEELFIFLTEITEITIPCR 150

151 VTDPQLVVTLHEKKGDVALPVPYDHQRGFSGIFEDRSYICKTTIGDREVD 200
    |||||||||||||||||||||||||||||||||||||||||||||||||
151 VTDPQLVVTLHEKKGDVALPVPYDHQRGFSGIFEDRSYICKTTIGDREVD 200

201 SDAYYVYRLQVSSINVSVNAVQTVVRQGENITLMCIVIGNEVVNFEWTYP 250
    |||||||||||||||||||||||||||||||||||||||||||||||||
201 SDAYYVYRLQVSSINVSVNAVQTVVRQGENITLMCIVIGNEVVNFEWTYP 250

251 RKESGRLVEPVTDFLLDMPYHIRSILHIPSAELEDSGTYTCNVTESVNDH 300
    |||||||||||||||||||||||||||||||||||||||||||||||||
251 RKESGRLVEPVTDFLLDMPYHIRSILHIPSAELEDSGTYTCNVTESVNDH 300

301 QDEKAINITVVESGYVRLLGEVGTLQFAELHRSRTLQVVFEAYPPPTVLW 350
    |||||||||||||||||||||||||||||||||||||||||||||||||
301 QDEKAINITVVESGYVRLLGEVGTLQFAELHRSRTLQVVFEAYPPPTVLW 350

351 FKDNRTLGDSSAGEIALSTRNVSETRYVSELTLVRVKVAEAGHYTMRAFH 400
    |||||||||||||||||||||||||||||||||||||||||||||||||
351 FKDNRTLGDSSAGEIALSTRNVSETRYVSELTLVRVKVAEAGHYTMRAFH 400

401 EDAEVQLSFQLQINVPVRVLELSESHPDSGEQTVRCRGRGMPQPNIIWSA 450
    |||||||||||||||||||||||||||||||||||||||||||||||||
401 EDAEVQLSFQLQINVPVRVLELSESHPDSGEQTVRCRGRGMPQPNIIWSA 450

451 CRDLKRCPRELPPTLLGNSSEEESQLETNVTYWEEEQEFEVVSTLRLQHV 500
    |||||||||||||||||||||||||||||||||||||||||||||||||
451 CRDLKRCPRELPPTLLGNSSEEESQLETNVTYWEEEQEFEVVSTLRLQHV 500

501 DRPLSVRCTLRNAVGQDTQEVIVVPHCESPASVAPDDPNPYLNPA      545
    |||||||||||||||||||||||||||||
501 DRPLSVRCTLRNAVGQDTQEVIVVPH...................      526
```

Figure 119

Alignment of HUMPRE_P4 (SEQ ID NO:274) to EL3B_HUMAN (SEQ ID NO:328)

```
  1 MMLRLLSSLLLVAVASGYGPPSSRPSSRVVNGEDAVPYSWPWQVSLQYEK  50
    ||||||||||||||||||||||||||||||||||||||||||||||||||
  1 MMLRLLSSLLLVAVASGYGPPSSRPSSRVVNGEDAVPYSWPWQVSLQYEK  50

51 SGSFYHTCGGSLIAPDWVVTAGHCISSSWTYQVVLGEYDRAVKEGPEQVI 100
    ||||||||||||||||||||||||||||||||||||||||||||||||||
 51 SGSFYHTCGGSLIAPDWVVTAGHCISSSWTYQVVLGEYDRAVKEGPEQVI 100

101 PINSGDLFVHPLWNRSCVACGNDIALIKLSRSAQLGDAVQLASLPPAGDI 150
    ||||||||||||||||||||||||||||||||||||||||||||||||||
101 PINSGDLFVHPLWNRSCVACGNDIALIKLSRSAQLGDAVQLASLPPAGDI 150

151 LPNETPCYITGWGRLYTNGPLPDKLQEALLPVVDYEHCSRWNWWGSSVKK 200
    ||||||||||||||||||||||||||||||||||||||||||||||||||
151 LPNETPCYITGWGRLYTNGPLPDKLQEALLPVVDYEHCSRWNWWGSSVKK 200

201 TMVCAGGDIRSGCNEAHGVHSSLRLHRLD                     229
    ||||||||||||||||
201 TMVCAGGDIRSGCN...............                     214
```

Figure 120

Alignment of HSGROW1_P11 (SEQ ID NO:276) to sp|P01241|SOMA_HUMAN
(SEQ ID NO:640) from: 1 to: 217

```
  1 MATGSRTSLLLAFGLLCLPWLQEGSAFPTIPLSRLFDNAMLRAHRLHQLA  50
    ||||||||||||||||||||||||||||||||||||||||||||||||||
  1 MATGSRTSLLLAFGLLCLPWLQEGSAFPTIPLSRLFDNAMLRAHRLHQLA  50

51 FDTYQEF...........................................  57
    |||||||
 51 FDTYQEFEEAYIPKEQKYSFLQNPQTSLCFSESIPTPSNREETQQKSNLE 100

58 .......................LVYGASDSNVYDLLKDLEEGIQTL  81
                           |||||||||||||||||||||||||||
101 LLRISLLLIQSWLEPVQFLRSVFANSLVYGASDSNVYDLLKDLEEGIQTL 150

82 MGRLEDGSPRTGQIFKQTYSKFDTNSHNDDALLKNYGLLYCFRKDMDKVE 131
    |||||||||||||||||||||||||||||||||||||||||||||||||
151 MGRLEDGSPRTGQIFKQTYSKFDTNSHNDDALLKNYGLLYCFRKDMDKVE 200

132 TFLRIVQCRSVEGSCGF 148
    |||||||||||||||||
201 TFLRIVQCRSVEGSCGF 217
```

Figure 121

Alignment of HUMCS2_P3 (SEQ ID NO:278) to CSH_HUMAN (SEQ ID
NO:330)

```
  1 MAPGSRTSLLLAFALLCLPWLQEAGAVQTVPLSRLFDHAMLQAHRAHQLA  50
    ||||||||||||||||||||||||||||||||||||||||||||||||||
 19 MAPGSRTSLLLAFALLCLPWLQEAGAVQTVPLSRLFDHAMLQAHRAHQLA  68

51 IDTYQEFEETYIPKDQKYSFLHDSQTSFCFSDSIPTPSNMEETQQKSNLE 100
    ||||||||||||||||||||||||||||||||||||||||||||||||||
 69 IDTYQEFEETYIPKDQKYSFLHDSQTSFCFSDSIPTPSNMEETQQKSNLE 118

101 LLRISLLLIESWLEPVRFLRSMFANNLVYDTSDSDDYHLLKDLEEGIQTL 150
    ||||||||||||||||||||||||||||||||||||||||||||||||||
119 LLRISLLLIESWLEPVRFLRSMFANNLVYDTSDSDDYHLLKDLEEGIQTL 168

151 MGVRVAPGVTNPGTPLASRAGGEKYCCPLFSSKALTQENSPYSSFRLVNP 200
    ||
169 MG............................................... 170

201 PGLSLHPEGEGGKWINERGREQCPSAWPLLLFLHFAEAGRRQPPDWADPQ 250

170 ................................................. 170

251 ADLQQV                                             256

Alignment of HUMCS2_P9 (SEQ ID NO:280) to CSH_HUMAN (SEQ ID NO:330)

```
  1 MAPGSRTSLLLAFALLCLPWLQEAGAVQTVPLSRLFDHAMLQAHRAHQLA  50
    |||||||||||||||||||||||||||||||||||||||||||||||||
 19 MAPGSRTSLLLAFALLCLPWLQEAGAVQTVPLSRLFDHAMLQAHRAHQLA  68

51 IDTYQEFEETYIPKDQKYSFLHDSQTSFCFSDSIPTPSNMEETQQKSNLE 100
    |||||||||||||||||||||||||||||||||||||||||||||||||
 69 IDTYQEFEETYIPKDQKYSFLHDSQTSFCFSDSIPTPSNMEETQQKSNLE 118

101 LLRISLLLIESWLEPVRFLRSMFANNLVYDTSDSDDYHLLKDLEEGIQTL 150
    |||||||||||||||||||||||||||||||||||||||||||||||||
119 LLRISLLLIESWLEPVRFLRSMFANNLVYDTSDSDDYHLLKDLEEGIQTL 168

151 MGVRVAPGVTNPGTPLASRAGGEKYCCPLFSKAGRRQPPDWADPQADLQQ 200
    ||
169 MG................................................ 170

Alignment of HUMFNC_P54 (SEQ ID NO:282) to FINC_HUMAN (SEQ ID NO:644)

```
  1 MLRGPGPGLLLLAVQCLGTAVPSTGASKSKRQAQQMVQPQSPVAVSQSKP  50
    ||||||||||||||||||||||||||||||||||||||||||||||||||
  1 MLRGPGPGLLLLAVQCLGTAVPSTGASKSKRQAQQMVQPQSPVAVSQSKP  50

51 GCYDNGKHYQINQQWERTYLGNALVCTCYGGSRGFNCESKPEAEETCFDK 100
    ||||||||||||||||||||||||||||||||||||||||||||||||||
 51 GCYDNGKHYQINQQWERTYLGNALVCTCYGGSRGFNCESKPEAEETCFDK 100

101 YTGNTYRVGDTYERPKDSMIWDCTCIGAGRGRISCTIANRCHEGGQSYKI 150
    ||||||||||||||||||||||||||||||||||||||||||||||||||
101 YTGNTYRVGDTYERPKDSMIWDCTCIGAGRGRISCTIANRCHEGGQSYKI 150

151 GDTWRRPHETGGYMLECVCLGNGKGEWTCKPIAEKCFDHAAGTSYVVGET 200
    ||||||||||||||||||||||||||||||||||||||||||||||||||
151 GDTWRRPHETGGYMLECVCLGNGKGEWTCKPIAEKCFDHAAGTSYVVGET 200

201 WEKPYQGWMMVDCTCLGEGSGRITCTSRNRCNDQDTRTSYRIGDTWSKKD 250
    ||||||||||||||||||||||||||||||||||||||||||||||||||
201 WEKPYQGWMMVDCTCLGEGSGRITCTSRNRCNDQDTRTSYRIGDTWSKKD 250

251 NRGNLLQCICTGNGRGEWKCERHTSVQTTSSGSGPFTDVRAAVYQPQPHP 300
    ||||||||||||||||||||||||||||||||||||||||||||||||||
251 NRGNLLQCICTGNGRGEWKCERHTSVQTTSSGSGPFTDVRAAVYQPQPHP 300

301 QPPPYGHCVTDSGVVYSVGMQWLKTQGNKQMLCTCLGNGVSCQETAVTQT 350
    ||||||||||||||||||||||||||||||||||||||||||||||||||
301 QPPPYGHCVTDSGVVYSVGMQWLKTQGNKQMLCTCLGNGVSCQETAVTQT 350

351 YGGNSNGEPCVLPFTYNGRTFYSCTTEGRQDGHLWCSTTSNYEQDQKYSF 400
    ||||||||||||||||||||||||||||||||||||||||||||||||||
351 YGGNSNGEPCVLPFTYNGRTFYSCTTEGRQDGHLWCSTTSNYEQDQKYSF 400

401 CTDHTVLVQTRGGNSNGALCHFPFLYNNHNYTDCTSEGRRDNMKWCGT   448
    ||||||||||| ||||||||||||||||||||||||||||||||||||
401 CTDHTVLVQTQGGNSNGALCHFPFLYNNHNYTDCTSEGRRDNMKWCGT   448

449 TQNYDADQKFGFCPMAAHEEICTTNEGVMYRIGDQWDKQHDMGHMMRCTC 498
    ||||||||||||||||||||||||||||||||||||||||||||||||||
449 TQNYDADQKFGFCPMAAHEEICTTNEGVMYRIGDQWDKQHDMGHMMRCTC 498

499 VGNGRGEWTCIAYSQLRDQCIVDDITYNVNDTFHKRHEEGHMLNCTCFGQ 548
    ||||||||||||||||||||||||||||||||||||||||||||||||||
499 VGNGRGEWTCIAYSQLRDQCIVDDITYNVNDTFHKRHEEGHMLNCTCFGQ 548

549 GRGRWKCDPVDQCQDSETGTFYQIGDSWEKYVHGVRYQCYCYGRGIGEWH 598
    ||||||||||||||||||||||||||||||||||||||||||||||||||
549 GRGRWKCDPVDQCQDSETGTFYQIGDSWEKYVHGVRYQCYCYGRGIGEWH 598

599 CQPLQTYPSSSGPVEVFITETPSQPNSHPIQWNAPQPSHISKYILRWRPK 648
    ||||||||||||||||||||||||||||||||||||||||||||||||||
599 CQPLQTYPSSSGPVEVFITETPSQPNSHPIQWNAPQPSHISKYILRWRPK 648
```

```
 649  NSVGRWKEATIPGHLNSYTIKGLKPGVVYEGQLISIQQYGHQEVTRFDFT   698
      |||||||||||||||||||||||||||||||||||||||||||||||||
 649  NSVGRWKEATIPGHLNSYTIKGLKPGVVYEGQLISIQQYGHQEVTRFDFT   698

699  TTSTSTPVTSNTVTGETTPFSPLVATSESVTEITASSFVVSWVSASDTVS   748
      |||||||||||||||||||||||||||||||||||||||||||||||||
 699  TTSTSTPVTSNTVTGETTPFSPLVATSESVTEITASSFVVSWVSASDTVS   748

749  GFRVEYELSEEGDEPQYLDLPSTATSVNIPDLLPGRKYIVNVYQISEDGE   798
      |||||||||||||||||||||||||||||||||||||||||||||||||
 749  GFRVEYELSEEGDEPQYLDLPSTATSVNIPDLLPGRKYIVNVYQISEDGE   798

799  QSLILSTSQTTAPDAPPD.TTVDQVDDTSIVVRWSRPQAPITGYRIVYSP   847
      ||||||||||||||||| |||||||||||||||||||||||||||||||
 799  QSLILSTSQTTAPDAPPDPT.VDQVDDTSIVVRWSRPQAPITGYRIVYSP   847

848  SVEGSSTELNLPETANSVTLSDLQPGVQYNITIYAVEENQESTPVVIQQE   897
      |||||||||||||||||||||||||||||||||||||||||||||||||
 848  SVEGSSTELNLPETANSVTLSDLQPGVQYNITIYAVEENQESTPVVIQQE   897

898  TTGTPRSDTVPSPRDLQFVEVTDVKVTIMWTPPESAVTGYRVDVIPVNLP   947
      |||||||||||||||||||||||||||||||||||||||||||||||||
 898  TTGTPRSDTVPSPRDLQFVEVTDVKVTIMWTPPESAVTGYRVDVIPVNLP   947

948  GEHGQRLPISRNTFAEVTGLSPGVTYYFKVFAVSHGRESKPLTAQQTTKL   997
      |||||||||||||||||||||||||||||||||||||||||||||||||
 948  GEHGQRLPISRNTFAEVTGLSPGVTYYFKVFAVSHGRESKPLTAQQTTKL   997

998  DAPTNLQFVNETDSTVLVRWTPPRAQITGYRLTVGLTRRGQPRQYNVGPS  1047
      |||||||||||||||||||||||||||||||||||||||||||||||||
 998  DAPTNLQFVNETDSTVLVRWTPPRAQITGYRLTVGLTRRGQPRQYNVGPS  1047

1048  VSKYPLRNLQPASEYTVSLVAIKGNQESPKATGVFTTLQPGSSIPPYNTE  1097
      |||||||||||||||||||||||||||||||||||||||||||||||||
1048  VSKYPLRNLQPASEYTVSLVAIKGNQESPKATGVFTTLQPGSSIPPYNTE  1097

1098  VTETTIVITWTPAPRIGFKLGVRPSQGGEAPREVTSDSGSIVVSGLTPGV  1147
      |||||||||||||||||||||||||||||||||||||||||||||||||
1098  VTETTIVITWTPAPRIGFKLGVRPSQGGEAPREVTSDSGSIVVSGLTPGV  1147

1148  EYVYTIQVLRDGQERDAPIVNKVVTPLSPPTNLHLEANPDTGVLTVSWER  1197
      |||||||||||||||||||||||||||||||||||||||||||||||||
1148  EYVYTIQVLRDGQERDAPIVNKVVTPLSPPTNLHLEANPDTGVLTVSWER  1197

1198  STTPDITGYRITTTPTNGQQGNSLEEVVHADQSSCTFDNLSPGLEYNVSV  1247
      |||||||||||||||||||||||||||||||||||||||||||||||||
1198  STTPDITGYRITTTPTNGQQGNSLEEVVHADQSSCTFDNLSPGLEYNVSV  1247

1248  YTVKDDKESVPISDTIIPGNRKISCYPESDTSNKSGD               1284
      ||||||||||||||||||
1248  YTVKDDKESVPISDTIIP...................              1265
```

Figure 124

Alignment of M85929_P3 (SEQ ID NO:284) to ITA8_HUMAN (SEQ ID NO:327)

```
  1 MSPGASRGPRGSQAPLIAPLCCAAAALGMLLWSPACQAFNLDVEKLTVYS  50
    ||||||||||||||||||||||||||||||||||||||||||||||||||
  1 MSPGASRGPRGSQAPLIAPLCCAAAALGMLLWSPACQAFNLDVEKLTVYS  50

51 GPKGSYFGYAVDFHIPDARTASVLVGAPKANTSQPDIVEGGAVYYCPWPA 100
    ||||||||||||||||||||||||||||||||||||||||||||||||||
 51 GPKGSYFGYAVDFHIPDARTASVLVGAPKANTSQPDIVEGGAVYYCPWPA 100

101 EGSAQCRQIPFDTTNNRKIRVNGTKEPIEFKSNQWFGATVKAHKGKVVAC 150
    ||||||||||||||||||||||||||||||||||||||||||||||||||
101 EGSAQCRQIPFDTTNNRKIRVNGTKEPIEFKSNQWFGATVKAHKGKVVAC 150

151 APLYHWRTLKPTPEKDPVGTCYVAIQNFSAYAEFSPCRNSNADPEGQGYC 200
    ||||||||||||||||||||||||||||||||||||||||||||||||||
151 APLYHWRTLKPTPEKDPVGTCYVAIQNFSAYAEFSPCRNSNADPEGQGYC 200

201 QAGFSLDFYKNGDLIVGGPGSFYWQGQVITASVADIIANYSFKDILRKLA 250
    ||||||||||||||||||||||||||||||||||||||||||||||||||
201 QAGFSLDFYKNGDLIVGGPGSFYWQGQVITASVADIIANYSFKDILRKLA 250

251 GEKQTEVAPASYDDSYLGYSVAAGEFTGDSQQELVAGIPRGAQNFGYVSI 300
    ||||||||||||||||||||||||||||||||||||||||||||||||||
251 GEKQTEVAPASYDDSYLGYSVAAGEFTGDSQQELVAGIPRGAQNFGYVSI 300

301 INSTDMTFIQNFTGEQMASYFGYTVVVSDVNSDGLDDVLVGAPLFMEREF 350
    ||||||||||||||||||||||||||||||||||||||||||||||||||
301 INSTDMTFIQNFTGEQMASYFGYTVVVSDVNSDGLDDVLVGAPLFMEREF 350

351 ESNPREVGQIYLYLQVSSLLFRDPQILTGTETFGRFGSAMAHLGDLNQDG 400
    ||||||||||||||||||||||||||||||||||||||||||||||||||
351 ESNPREVGQIYLYLQVSSLLFRDPQILTGTETFGRFGSAMAHLGDLNQDG 400

401 YNDIAIGVPFAGKDQRGKVLIYNGKDGLNTKPSQVLQGVWASHAVPSGF  450
    ||||||||||||||||||||||||||||||||||||||||||||||||||
401 YNDIAIGVPFAGKDQRGKVLIYNGKDGLNTKPSQVLQGVWASHAVPSGF  450

451 GFTLRGDSDIDKNDYPDLIVGAFGTGKVAVYRARPVVTVDAQLLLHPMII 500
    ||||||||||||||||||||||||||||||||||||||||||||||||||
451 GFTLRGDSDIDKNDYPDLIVGAFGTGKVAVYRARPVVTVDAQLLLHPMII 500

501 NLENKTCQVPDSMTSAACFSLRVCASVTGQSIANTIVLMAEVQLDSLKQK 550
    ||||||||||||||||||||||||||||||||||||||||||||||||||
501 NLENKTCQVPDSMTSAACFSLRVCASVTGQSIANTIVLMAEVQLDSLKQK 550

551 GAIKRTLFLDNHQAHRVFPLVIKRQKSHQCQDFIVYLRDETEFRDKLSPI 600
    ||||||||||||||||||||||||||||||||||||||||||||||||||
551 GAIKRTLFLDNHQAHRVFPLVIKRQKSHQCQDFIVYLRDETEFRDKLSPI 600

601 NISLNYSLDESTFKEGLEVKPILNYYRENIVSEQR                635
    |||||||||||||||||||||||||||||||||||
601 NISLNYSLDESTFKEGLEVKPILNYYRENIVSEQA                635
```

Figure 125

Alignment of S56205_P7 (SEQ ID NO:285) to IBP3_HUMAN (SEQ ID NO:647)

```
  1 MQRARPTLWAAALTLLVLLRGPPVARAGASSGGLGPVVRCEPCDARALAQ  50
    ||||||||||||||||||||||||||||||||||||||||||||||||||
  1 MQRARPTLWAAALTLLVLLRGPPVARAGASSGGLGPVVRCEPCDARALAQ  50

51 CAPPPAVCAELVREPGCGCCLTCALSEGQPCGIYTERCGSGLRCQPSPDE 100
    ||||||||||||||||||||||||||||||||||||||||||||||||||
 51 CAPPPAVCAELVREPGCGCCLTCALSEGQPCGIYTERCGSGLRCQPSPDE 100

101 ARPLQALLDGRGLCVNASAVSRLRAYLLPAPPAPGEPPAPGNASESEEDR 150
    |||||||||||||||||||||||||||||||      |||||||||||||
101 ARPLQALLDGRGLCVNASAVSRLRAYLLPA......PPAPGNASESEEDR 144

151 SAGSVESPSVSSTHRVSDPKFHPLHSKIIIIKKGHAKDSQRYKVDYESQS 200
    ||||||||||||||||||||||||||||||||||||||||||||||||||
145 SAGSVESPSVSSTHRVSDPKFHPLHSKIIIIKKGHAKDSQRYKVDYESQS 194

201 TDTQNFSSESKRETEYGPCRREMEDTLNHLKFLNVLSPRGVHIPNCDKKG 250
    ||||||||||||||||||||||||||||||||||||||||||||||||||
195 TDTQNFSSESKRETEYGPCRREMEDTLNHLKFLNVLSPRGVHIPNCDKKG 244

251 FYKKKQCRPSKGRKRGFCWCVDKYGQPLPGYTTKGKEDVHCYSMQSK 297
    |||||||||||||||||||||||||||||||||||||||||||||||
245 FYKKKQCRPSKGRKRGFCWCVDKYGQPLPGYTTKGKEDVHCYSMQSK 291
```

Figure 126

Alignment of S56205_P15 (SEQ ID NO:287) to IBP3_HUMAN (SEQ ID NO:647)

```
  1 MQRARPTLWAAALTLLVLLRGPPVARAGASSAGLGPVVRCEPCDARALA  49
    ||||||||||||||||||||||||||||| ||||||||||||||||||||
  1 MQRARPTLWAAALTLLVLLRGPPVARAGASSGGLGPVVRCEPCDARALA  49

50 QCAPPPAVCAELVREPGCGCCLTCALSEGQPCGIYTERCGSGLRCQPSPD  99
    |||||||||||||||||||||||||||||||||||||||||||||||||
 50 QCAPPPAVCAELVREPGCGCCLTCALSEGQPCGIYTERCGSGLRCQPSPD  99

100 EARPLQALLDGRGLCVNASAVSRLRAYLLPAPPAPAARLGRQMRALRLGA 149
    |||||||||||||||||||||||||||||||||||
100 EARPLQALLDGRGLCVNASAVSRLRAYLLPAPPAP...............  134

150 EDQPLPAWIPQLRAVYCRPIPARPACQAACPGCRRHAAGATHALGRCADS 199

134 .................................................  134

200 AGAAPRAAGGAGWRELGGLGSRGALRDRCRRCWTAAGSASTLVPSAACAP 249

134 .................................................  134

250 TCCQRRQLQEMLVSRRKTAAPAVWRARPSPARTGCLIPSSTPSIQR      295

Alignment of HUMREBP_P2 (SEQ ID NO:289) to RNBP_HUMAN (SEQ ID NO:648)

```
  1 MEKERETLQAWKERVGQELDRVVAFWMEHSHDQEHGGFFTCLGREGRVYD  50
    ||||||||||||||||||||||||||||||||||||||||||||||||||
  1 MEKERETLQAWKERVGQELDRVVAFWMEHSHDQEHGGFFTCLGREGRVYD  50

51 DLKYVWLQGRQVWMYCRLYRTFERFRHAQLLDAAKAGGEFLLRYARVAPP 100
    ||||||||||||||||||||||||||||||||||||||||||||||||||
 51 DLKYVWLQGRQVWMYCRLYRTFERFRHAQLLDAAKAGGEFLLRYARVAPP 100

101 GKKCAFVLTRDGRPVKVQRTIFSECFYTMAMNELWRATGEVRYQTEAVEM 150
    ||||||||||||||||||||||||||||||||||||||||||||||||||
101 GKKCAFVLTRDGRPVKVQRTIFSECFYTMAMNELWRATGEVRYQTEAVEM 150

151 MDQIVHWVQEDASGLGRPQLQGAPAAEPMAVPMMLLNLVEQLGEADEELA 200
    ||||||||||||||||||||||||||||||||||||||||||||||||||
151 MDQIVHWVQEDASGLGRPQLQGAPAAEPMAVPMMLLNLVEQLGEADEELA 200

201 GKYAELGDWCARRILQHVQRDGQAVLENVSEGGKELPGCLGRQQNPGHTL 250
    ||||||||||||||||||||||||||||||||||||||||||||||||||
201 GKYAELGDWCARRILQHVQRDGQAVLENVSEGGKELPGCLGRQQNPGHTL 250

251 EAGWFLLRHCIRKGDPELRAHVIDKFLLLPFHSGWDPDHGGLFYFQDADN 300
    ||||||||||||||||||||||||||||||||||||||||||||||||||
251 EAGWFLLRHCIRKGDPELRAHVIDKFLLLPFHSGWDPDHGGLFYFQDADN 300

301 FCPTQLEWAMKLWWPHSEAMIAFLMGYSDSGDPVLLRLFYQVAEYTFRQG 350
    |||||||||||||||||||||||||||||||||||||||||||||||||
301 FCPTQLEWAMKLWWPHSEAMIAFLMGYSDSGDPVLLRLFYQVAEYTFRQ. 349

351 LYRPG                                             355

Alignment of HUMREBP_Skippingexon_10_P (SEQ ID NO:291) to RNBP_HUMAN (SEQ ID NO:648)

```
  1 MEKERETLQAWKERVGQELDRVVAFWMEHSHDQEHGGFFTCLGREGRVYD  50
    ||||||||||||||||||||||||||||||||||||||||||||||||||
  1 MEKERETLQAWKERVGQELDRVVAFWMEHSHDQEHGGFFTCLGREGRVYD  50

51 DLKYVWLQGRQVWMYCRLYRTFERFRHAQLLDAAKAGGEFLLRYARVAPP 100
    ||||||||||||||||||||||||||||||||||||||||||||||||||
 51 DLKYVWLQGRQVWMYCRLYRTFERFRHAQLLDAAKAGGEFLLRYARVAPP 100

101 GKKCAFVLTRDGRPVKVQRTIFSECFYTMAMNELWRATGEVRYQTEAVEM 150
    ||||||||||||||||||||||||||||||||||||||||||||||||||
101 GKKCAFVLTRDGRPVKVQRTIFSECFYTMAMNELWRATGEVRYQTEAVEM 150

151 MDQIVHWVQEDASGLGRPQLQGAPAAEPMAVPMMLLNLVEQLGEADEELA 200
    ||||||||||||||||||||||||||||||||||||||||||||||||||
151 MDQIVHWVQEDASGLGRPQLQGAPAAEPMAVPMMLLNLVEQLGEADEELA 200

201 GKYAELGDWCARRILQHVQRDGQAVLENVSEGGKELPGCLGRQQNPGHTL 250
    ||||||||||||||||||||||||||||||||||||||||||||||||||
201 GKYAELGDWCARRILQHVQRDGQAVLENVSEGGKELPGCLGRQQNPGHTL 250

251 EAGWFLLRHCIRKGDPELRAHVIDKFLLLPFHSGWDPDHGGLFYFQDADN 300
    ||||||||||||||||||||||||||||||||||||||||||||||||||
251 EAGWFLLRHCIRKGDPELRAHVIDKFLLLPFHSGWDPDHGGLFYFQDADN 300

301 FCPTQLEWAMKLWWPHSEAMIAFLMGYSDSGDPVLLRLFYQVAEYTFRQA 350
    |||||||||||||||||||||||||||||||||||||||||||||||||
301 FCPTQLEWAMKLWWPHSEAMIAFLMGYSDSGDPVLLRLFYQVAEYTFRQ. 349

351 ASTCRGA                                            357

Alignment OF HUMREBP_P3 (SEQ ID NO:293) to RNBP_HUMAN (SEQ ID NO:648)

```
  1  MEKERETLQAWKERVGQELDRVVAFWMEHSHDQEHGGFFTCLGREGRVYD   50
     ||||||||||||||||||||||||||||||||||||||||||||||||||
  1  MEKERETLQAWKERVGQELDRVVAFWMEHSHDQEHGGFFTCLGREGRVYD   50

51  DLKYVWLQGRQVWMYCRLYRTFERFRHAQLLDAAKAGGEFLLRYARVAPP  100
     ||||||||||||||||||||||||||||||||||||||||||||||||||
 51  DLKYVWLQGRQVWMYCRLYRTFERFRHAQLLDAAKAGGEFLLRYARVAPP  100

101  GKKCAFVLTRDGRPVKVQRTIFSECFYTMAMNELWRATGEVRYQTEAVEM  150
     ||||||||||||||||||||||||||||||||||||||||||||||||||
101  GKKCAFVLTRDGRPVKVQRTIFSECFYTMAMNELWRATGEVRYQTEAVEM  150

151  MDQIVHWVQEDASGLGRPQLQGAPAAEPMAVPMMLLNLVEQLGEADEELA  200
     ||||||||||||||||||||||||||||||||||||||||||||||||||
151  MDQIVHWVQEDASGLGRPQLQGAPAAEPMAVPMMLLNLVEQLGEADEELA  200

201  GKYAELGDWCARRILQHVQARAGRGGSCL                       229
     |||||||||||||||||||
201  GKYAELGDWCARRILQHVQ..........                       219
```

Figure 130

Alignment OF HUMREBP_P4 (SEQ ID NO:295) to RNBP_HUMAN (SEQ ID NO:648)

```
  1  MEKERETLQAWKERVGQELDRVVAFWMEHSHDQEHGGFFTCLGREGRVYD   50
     ||||||||||||||||||||||||||||||||||||||||||||||||||
  1  MEKERETLQAWKERVGQELDRVVAFWMEHSHDQEHGGFFTCLGREGRVYD   50

51  DLKYVWLQGRQVWMYCRLYRTFERFRHAQLLDAAKAGGEFLLRYARVAPP  100
     ||||||||||||||||||||||||||||||||||||||||||||||||||
 51  DLKYVWLQGRQVWMYCRLYRTFERFRHAQLLDAAKAGGEFLLRYARVAPP  100

101  GKKCAFVLTRDGRPVKVQRTIFSECFYTMAMNELWRATGEVRY.......  143
     ||||||||||||||||||||||||||||||||||||||||||
101  GKKCAFVLTRDGRPVKVQRTIFSECFYTMAMNELWRATGEVRYQTEAVEM  150

144  ........QEDASGLGRPQLQGAPAAEPMAVPMMLLNLVEQLGEADEELA  185
             ||||||||||||||||||||||||||||||||||||||||||
151  MDQIVHWVQEDASGLGRPQLQGAPAAEPMAVPMMLLNLVEQLGEADEELA  200

186  GKYAELGDWCARRILQHVQATRWKPAGFCSVIAFGKATPNFEPT        229
     |||||||||||||||||||
201  GKYAELGDWCARRILQHVQ........................        219
```

Figure 131

Alignment of HUMREBP_P1 (SEQ ID NO:297) to RNBP_HUMAN (SEQ ID NO:648)

```
  1 MEKERETLQAWKERVGQELDRVVAFWMEHSHDQEHGGFFTCLGREGRVYD  50
    ||||||||||||||||||||||||||||||||||||||||||||||||||
  1 MEKERETLQAWKERVGQELDRVVAFWMEHSHDQEHGGFFTCLGREGRVYD  50

51 DLKYVWLQGRQVWMYCRLYRTFERFRHAQLLDAAKAGGEFLLRYARVAPP 100
    ||||||||||||||||||||||||||||||||||||||||||||||||||
 51 DLKYVWLQGRQVWMYCRLYRTFERFRHAQLLDAAKAGGEFLLRYARVAPP 100

101 GKKCAFVLTRDGRPVKVQRTIFSECFYTMAMNELWRATGEVRYQTEAVEM 150
    ||||||||||||||||||||||||||||||||||||||||||||||||||
101 GKKCAFVLTRDGRPVKVQRTIFSECFYTMAMNELWRATGEVRYQTEAVEM 150

151 MDQIVHWVQEDASGLGRPQLQGAPAAEPMAVPMMLLNLVEQLGEADEELA 200
    ||||||||||||||||||||||||||||||||||||||||||||||||||
151 MDQIVHWVQEDASGLGRPQLQGAPAAEPMAVPMMLLNLVEQLGEADEELA 200

201 GKYAELGDWCARRILQHVQRDGQAVLENVSEGGKELPGCLGRQQNPGHTL 250
    ||||||||||||||||||||||||||||||||||||||||||||||||||
201 GKYAELGDWCARRILQHVQRDGQAVLENVSEGGKELPGCLGRQQNPGHTL 250

251 EAGWFLLRHCIRKGDPELRAHVIDKFLLLPFHSGWDPDHGGLFYFQDADN 300
    ||||||||||||||||||||||||||||||||||||||||||||||||||
251 EAGWFLLRHCIRKGDPELRAHVIDKFLLLPFHSGWDPDHGGLFYFQDADN 300

301 FCPTQLEWAMKLWWPHSEAMIAFLMGYSDSGDPVLLRLFYQVAEYTFRQA 350
    |||||||||||||||||||||||||||||||||||||||||||||||
301 FCPTQLEWAMKLWWPHSEAMIAFLMGYSDSGDPVLLRLFYQVAEYTFR.. 348

351 GAQWRDLSSLQPPPPVFKLFSRLSLPSILLGLQFRDPEYGEWFGYLSREG 400
                                   ||||||||||||||||||||
349 ................................QFRDPEYGEWFGYLSREG 366

401 KVALSIKGGPFKGCFHVPRCLAMCEEMLGALLSRPAPAPSPAPTPACRGA 450
    ||||||||||||||||||||||||||||||||||||||||||||||||||
367 KVALSIKGGPFKGCFHVPRCLAMCEEMLGALLSRPAPAPSPAPTPACRGA 416

Alignment OF HSHGFR _Skipping_exon_3_P (SEQ ID NO:299) to HGF_HUMAN (SEQ ID NO:649)

```
  1 MWVTKLLPALLLQHVLLHLLLLPIAIPYAEGQRKRRNTIHEFKKSAKTTL 50
    |||||||||||||||||||||||||||||||||||||||||||||||||
  1 MWVTKLLPALLLQHVLLHLLLLPIAIPYAEGQRKRRNTIHEFKKSAKTTL 50

51 IKIDPALKIKTKKVNTADQCANRCTRNKGLPFTCKLH             87
    |||||||||||||||||||||||||||||||||||
 51 IKIDPALKIKTKKVNTADQCANRCTRNKGLPFTCK..             85
```

Figure 133

Alignment of HSHGFR_Skipping_exon_4_P (SEQ ID NO:301) to HGF_HUMAN (SEQ ID NO:649)

```
  1 MWVTKLLPALLLQHVLLHLLLLPIAIPYAEGQRKRRNTIHEFKKSAKTTL  50
    |||||||||||||||||||||||||||||||||||||||||||||||||
  1 MWVTKLLPALLLQHVLLHLLLLPIAIPYAEGQRKRRNTIHEFKKSAKTTL  50

51 IKIDPALKIKTKKVNTADQCANRCTRNKGLPFTCKAFVFDKARKQCLWFP 100
    |||||||||||||||||||||||||||||||||||||||||||||||||
 51 IKIDPALKIKTKKVNTADQCANRCTRNKGLPFTCKAFVFDKARKQCLWFP 100

101 FNSMSSGVKKEFGHEFDLYENKAFCLRAIGVKTYRKTTVEILEGKKGDPG 150
    ||||||||||||||||||||||
101 FNSMSSGVKKEFGHEFDLYENK............................ 122

151 VSQAIQRYATKSVTFLSVQKLNA                            173

Alignment of HSHGFR_Skipping_exon_7_P (SEQ ID NO:303) to HGF_HUMAN (SEQ ID NO:649)

```
  1 MWVTKLLPALLLQHVLLHLLLLPIAIPYAEGQRKRRNTIHEFKKSAKTTL  50
    |||||||||||||||||||||||||||||||||||||||||||||||||
  1 MWVTKLLPALLLQHVLLHLLLLPIAIPYAEGQRKRRNTIHEFKKSAKTTL  50

51 IKIDPALKIKTKKVNTADQCANRCTRNKGLPFTCKAFVFDKARKQCLWFP 100
    |||||||||||||||||||||||||||||||||||||||||||||||||
 51 IKIDPALKIKTKKVNTADQCANRCTRNKGLPFTCKAFVFDKARKQCLWFP 100

101 FNSMSSGVKKEFGHEFDLYENKDYIRNCIIGKGRSYKGTVSITKSGIKCQ 150
    |||||||||||||||||||||||||||||||||||||||||||||||||
101 FNSMSSGVKKEFGHEFDLYENKDYIRNCIIGKGRSYKGTVSITKSGIKCQ 150

151 PWSSMIPHEHSFLPSSYRGKDLQENYCRNPRGEEGGPWCFTSNPEVRYEV 200
    |||||||||||||||||||||||||||||||||||||||||||||||||
151 PWSSMIPHEHSFLPSSYRGKDLQENYCRNPRGEEGGPWCFTSNPEVRYEV 200

201 CDIPQCSEVECMTCNGESYRGLMDHTESGKICQRWDHQTPHRHKFLPES  249
    ||||||||||||||||||||||||||||||||||||||||||||||||
201 CDIPQCSEVECMTCNGESYRGLMDHTESGKICQRWDHQTPHRHKFLPE.  248
```

Figure 135

Alignment of HSHGFR_Skipping_exon_9_P (SEQ ID NO:305) to HGF_HUMAN (SEQ ID NO:649)

```
  1 MWVTKLLPALLLQHVLLHLLLLPIAIPYAEGQRKRRNTIHEFKKSAKTTL  50
    |||||||||||||||||||||||||||||||||||||||||||||||||
  1 MWVTKLLPALLLQHVLLHLLLLPIAIPYAEGQRKRRNTIHEFKKSAKTTL  50

51 IKIDPALKIKTKKVNTADQCANRCTRNKGLPFTCKAFVFDKARKQCLWFP 100
    |||||||||||||||||||||||||||||||||||||||||||||||||
 51 IKIDPALKIKTKKVNTADQCANRCTRNKGLPFTCKAFVFDKARKQCLWFP 100

101 FNSMSSGVKKEFGHEFDLYENKDYIRNCIIGKGRSYKGTVSITKSGIKCQ 150
    |||||||||||||||||||||||||||||||||||||||||||||||||
101 FNSMSSGVKKEFGHEFDLYENKDYIRNCIIGKGRSYKGTVSITKSGIKCQ 150

151 PWSSMIPHEHSFLPSSYRGKDLQENYCRNPRGEEGGPWCFTSNPEVRYEV 200
    |||||||||||||||||||||||||||||||||||||||||||||||||
151 PWSSMIPHEHSFLPSSYRGKDLQENYCRNPRGEEGGPWCFTSNPEVRYEV 200

201 CDIPQCSEVECMTCNGESYRGLMDHTESGKICQRWDHQTPHRHKFLPERY 250
    |||||||||||||||||||||||||||||||||||||||||||||||||
201 CDIPQCSEVECMTCNGESYRGLMDHTESGKICQRWDHQTPHRHKFLPERY 250

251 PDKGFDDNYCRNPDGQPRPWCYTLDPHTRWEYCAIKTCADNTMNDTDVPL 300
    |||||||||||||||||||||||||||||||||||||||||||||||||
251 PDKGFDDNYCRNPDGQPRPWCYTLDPHTRWEYCAIKTCADNTMNDTDVPL 300

301 ETTECIQGQGEGYRGTVNTIWNGIPCQRWDSQYPHEHDMTPENFKCKLLS 350
    |||||||||||||||||||||||||||||||||||||||||||
301 ETTECIQGQGEGYRGTVNTIWNGIPCQRWDSQYPHEHDMTPENFKCK... 345

351 WEWQKLYGQLIPNKIWTNMFNVGQEHGRLTSSYLLGTRCK           390

Alignment OF HSU16826_Skippingexon_2_P (SEQ ID NO:307) to CART_HUMAN (SEQ ID NO:650)

```
  1 MESSRVRLLPLLGAALLLMLPLLGTRAQEDAELQPRALDIYSAVDDASHE  50
    ||||||||||||||||||||||||||||||||||||||||||||||||||
  1 MESSRVRLLPLLGAALLLMLPLLGTRAQEDAELQPRALDIYSAVDDASHE  50

51 KEL..........................CDAGEQCAVRKGARIGKLC   72
    |||                           ||||||||||||||||||||
 51 KELIEALQEVLKKLKSKRVPIYEKKYGQVPMCDAGEQCAVRKGARIGKLC 100

73 DCPRGTSCNSFLLKCL                                   88
    ||||||||||||||||
101 DCPRGTSCNSFLLKCL                                  116
```

Figure 137

Alignment of HSPCHDP7_Skippingexon_7_P (SEQ ID NO:309) to DPP4_HUMAN (SEQ ID NO:651)

```
  1 MKTPWKVLLGLLGAAALVTIITVPVVLLNKGTDDATADSRKTYTLTDYLK  50
    ||||||||||||||||||||||||||||||||||||||||||||||||||
  1 MKTPWKVLLGLLGAAALVTIITVPVVLLNKGTDDATADSRKTYTLTDYLK  50

51 NTYRLKLYSLRWISDHEYLYKQENNILVFNAEYGNSSVFLENSTFDEFGH 100
    ||||||||||||||||||||||||||||||||||||||||||||||||||
 51 NTYRLKLYSLRWISDHEYLYKQENNILVFNAEYGNSSVFLENSTFDEFGH 100

101 SINDYSISPDGQFILLEYNYVKQWRHSYTASYDIYDLNKRHMFGTMTFML 150
    |||||||||||||||||||||||||||||||||||||||
101 SINDYSISPDGQFILLEYNYVKQWRHSYTASYDIYDLNKR..........140

151 KLNQIYQVTESHGRGKKI                                168

Alignment of HSPCHDP7_Skippingexon_9_P (SEQ ID NO:311) to DPP4_HUMAN (SEQ ID NO:651)

```
  1 MKTPWKVLLGLLGAAALVTIITVPVVLLNKGTDDATADSRKTYTLTDYLK  50
    ||||||||||||||||||||||||||||||||||||||||||||||||||
  1 MKTPWKVLLGLLGAAALVTIITVPVVLLNKGTDDATADSRKTYTLTDYLK  50

51 NTYRLKLYSLRWISDHEYLYKQENNILVFNAEYGNSSVFLENSTFDEFGH 100
    ||||||||||||||||||||||||||||||||||||||||||||||||||
 51 NTYRLKLYSLRWISDHEYLYKQENNILVFNAEYGNSSVFLENSTFDEFGH 100

101 SINDYSISPDGQFILLEYNYVKQWRHSYTASYDIYDLNKRQLITEERIPN 150
    ||||||||||||||||||||||||||||||||||||||||||||||||||
101 SINDYSISPDGQFILLEYNYVKQWRHSYTASYDIYDLNKRQLITEERIPN 150

151 NTQWVTWSPVGHKLAYVWNNDIYVKIEPNLPSYRITWTGKEDIIYNGITD 200
    ||||||||||||||||||||||||||||||||||||||||||||||||||
151 NTQWVTWSPVGHKLAYVWNNDIYVKIEPNLPSYRITWTGKEDIIYNGITD 200

201 WVYEGRSCESNCKVLCCKYRLSQLSHQCNFHTNHCSCFYVDRGSLLV     247
    ||||
201 WVYE..........................................     204
```

Figure 139

Alignment of HSPCHDP7_Skippingexon_19_P (SEQ ID NO:313) to
DPP4_HUMAN (SEQ ID NO:651)

```
  1 MKTPWKVLLGLLGAAALVTIITVPVVLLNKGTDDATADSRKTYTLTDYLK  50
    ||||||||||||||||||||||||||||||||||||||||||||||||||
  1 MKTPWKVLLGLLGAAALVTIITVPVVLLNKGTDDATADSRKTYTLTDYLK  50

51 NTYRLKLYSLRWISDHEYLYKQENNILVFNAEYGNSSVFLENSTFDEFGH 100
    ||||||||||||||||||||||||||||||||||||||||||||||||||
 51 NTYRLKLYSLRWISDHEYLYKQENNILVFNAEYGNSSVFLENSTFDEFGH 100

101 SINDYSISPDGQFILLEYNYVKQWRHSYTASYDIYDLNKRQLITEERIPN 150
    ||||||||||||||||||||||||||||||||||||||||||||||||||
101 SINDYSISPDGQFILLEYNYVKQWRHSYTASYDIYDLNKRQLITEERIPN 150

151 NTQWVTWSPVGHKLAYVWNNDIYVKIEPNLPSYRITWTGKEDIIYNGITD 200
    ||||||||||||||||||||||||||||||||||||||||||||||||||
151 NTQWVTWSPVGHKLAYVWNNDIYVKIEPNLPSYRITWTGKEDIIYNGITD 200

201 WVYEEEVFSAYSALWWSPNGTFLAYAQFNDTEVPLIEYSFYSDESLQYPK 250
    ||||||||||||||||||||||||||||||||||||||||||||||||||
201 WVYEEEVFSAYSALWWSPNGTFLAYAQFNDTEVPLIEYSFYSDESLQYPK 250

251 TVRVPYPKAGAVNPTVKFFVVNTDSLSSVTNATSIQITAPASMLIGDHYL 300
    ||||||||||||||||||||||||||||||||||||||||||||||||||
251 TVRVPYPKAGAVNPTVKFFVVNTDSLSSVTNATSIQITAPASMLIGDHYL 300

301 CDVTWATQERISLQWLRRIQNYSVMDICDYDESSGRWNCLVARQHIEMST 350
    ||||||||||||||||||||||||||||||||||||||||||||||||||
301 CDVTWATQERISLQWLRRIQNYSVMDICDYDESSGRWNCLVARQHIEMST 350

351 TGWVGRFRPSEPHFTLDGNSFYKIISNEEGYRHICYFQIDKKDCTFITKG 400
    ||||||||||||||||||||||||||||||||||||||||||||||||||
351 TGWVGRFRPSEPHFTLDGNSFYKIISNEEGYRHICYFQIDKKDCTFITKG 400

401 TWEVIGIEALTSDYLYYISNEYKGMPGGRNLYKIQLSDYTKVTCLSCELN 450
    ||||||||||||||||||||||||||||||||||||||||||||||||||
401 TWEVIGIEALTSDYLYYISNEYKGMPGGRNLYKIQLSDYTKVTCLSCELN 450

451 PERCQYYSVSFSKEAKYYQLRCSGPGLPLYTLHSSVNDKGLRVLEDNSAL 500
    ||||||||||||||||||||||||||||||||||||||||||||||||||
451 PERCQYYSVSFSKEAKYYQLRCSGPGLPLYTLHSSVNDKGLRVLEDNSAL 500

501 DKMLQNVQMPSKKLDFIILNETSMQAHVVKKQTLSSD                537
    |||||||||||||||||||||||||
501 DKMLQNVQMPSKKLDFIILNET...............                522
```

Figure 140

Alignment OF HSPCHDP7_Skippingexon_21_P (SEQ ID NO:315) to
DPP4_HUMAN (SEQ ID NO:651)

```
  1 MKTPWKVLLGLLGAAALVTIITVPVVLLNKGTDDATADSRKTYTLTDYLK  50
    ||||||||||||||||||||||||||||||||||||||||||||||||||
  1 MKTPWKVLLGLLGAAALVTIITVPVVLLNKGTDDATADSRKTYTLTDYLK  50

51 NTYRLKLYSLRWISDHEYLYKQENNILVFNAEYGNSSVFLENSTFDEFGH 100
    ||||||||||||||||||||||||||||||||||||||||||||||||||
 51 NTYRLKLYSLRWISDHEYLYKQENNILVFNAEYGNSSVFLENSTFDEFGH 100

101 SINDYSISPDGQFILLEYNYVKQWRHSYTASYDIYDLNKRQLITEERIPN 150
    ||||||||||||||||||||||||||||||||||||||||||||||||||
101 SINDYSISPDGQFILLEYNYVKQWRHSYTASYDIYDLNKRQLITEERIPN 150

151 NTQWVTWSPVGHKLAYVWNNDIYVKIEPNLPSYRITWTGKEDIIYNGITD 200
    ||||||||||||||||||||||||||||||||||||||||||||||||||
151 NTQWVTWSPVGHKLAYVWNNDIYVKIEPNLPSYRITWTGKEDIIYNGITD 200

201 WVYEEEVFSAYSALWWSPNGTFLAYAQFNDTEVPLIEYSFYSDESLQYPK 250
    ||||||||||||||||||||||||||||||||||||||||||||||||||
201 WVYEEEVFSAYSALWWSPNGTFLAYAQFNDTEVPLIEYSFYSDESLQYPK 250

251 TVRVPYPKAGAVNPTVKFFVVNTDSLSSVTNATSIQITAPASMLIGDHYL 300
    ||||||||||||||||||||||||||||||||||||||||||||||||||
251 TVRVPYPKAGAVNPTVKFFVVNTDSLSSVTNATSIQITAPASMLIGDHYL 300

301 CDVTWATQERISLQWLRRIQNYSVMDICDYDESSGRWNCLVARQHIEMST 350
    ||||||||||||||||||||||||||||||||||||||||||||||||||
301 CDVTWATQERISLQWLRRIQNYSVMDICDYDESSGRWNCLVARQHIEMST 350

351 TGWVGRFRPSEPHFTLDGNSFYKIISNEEGYRHICYFQIDKKDCTFITKG 400
    ||||||||||||||||||||||||||||||||||||||||||||||||||
351 TGWVGRFRPSEPHFTLDGNSFYKIISNEEGYRHICYFQIDKKDCTFITKG 400

401 TWEVIGIEALTSDYLYYISNEYKGMPGGRNLYKIQLSDYTKVTCLSCELN 450
    ||||||||||||||||||||||||||||||||||||||||||||||||||
401 TWEVIGIEALTSDYLYYISNEYKGMPGGRNLYKIQLSDYTKVTCLSCELN 450

451 PERCQYYSVSFSKEAKYYQLRCSGPGLPLYTLHSSVNDKGLRVLEDNSAL 500
    ||||||||||||||||||||||||||||||||||||||||||||||||||
451 PERCQYYSVSFSKEAKYYQLRCSGPGLPLYTLHSSVNDKGLRVLEDNSAL 500

501 DKMLQNVQMPSKKLDFIILNETKFWYQMILPPHFDKSKKYPLLLDVYAGP 550
    ||||||||||||||||||||||||||||||||||||||||||||||||||
501 DKMLQNVQMPSKKLDFIILNETKFWYQMILPPHFDKSKKYPLLLDVYAGP 550

551 CSQKADTVFRLNWATYLASTENIIVASFDGRGSGYQGDKIMHAINRRLGT 600
    ||||||||||||||||||||||||||||||||||||||||||||||||||
551 CSQKADTVFRLNWATYLASTENIIVASFDGRGSGYQGDKIMHAINRRLGT 600

601 FEVEDQIEAASHMEGT                                  616
    ||||||||||
601 FEVEDQIEAA......                                  610
```

Alignment of HSPCHDP_Skippingexon_22_P (SEQ ID NO:317) to DPP4_HUMAN SEQ ID NO:651

```
  1 MKTPWKVLLGLLGAAALVTIITVPVVLLNKGTDDATADSRKTYTLTDYLK  50
    ||||||||||||||||||||||||||||||||||||||||||||||||||
  1 MKTPWKVLLGLLGAAALVTIITVPVVLLNKGTDDATADSRKTYTLTDYLK  50

51 NTYRLKLYSLRWISDHEYLYKQENNILVFNAEYGNSSVFLENSTFDEFGH 100
    ||||||||||||||||||||||||||||||||||||||||||||||||||
 51 NTYRLKLYSLRWISDHEYLYKQENNILVFNAEYGNSSVFLENSTFDEFGH 100

101 SINDYSISPDGQFILLEYNYVKQWRHSYTASYDIYDLNKRQLITEERIPN 150
    ||||||||||||||||||||||||||||||||||||||||||||||||||
101 SINDYSISPDGQFILLEYNYVKQWRHSYTASYDIYDLNKRQLITEERIPN 150

151 NTQWVTWSPVGHKLAYVWNNDIYVKIEPNLPSYRITWTGKEDIIYNGITD 200
    ||||||||||||||||||||||||||||||||||||||||||||||||||
151 NTQWVTWSPVGHKLAYVWNNDIYVKIEPNLPSYRITWTGKEDIIYNGITD 200

201 WVYEEEVFSAYSALWWSPNGTFLAYAQFNDTEVPLIEYSFYSDESLQYPK 250
    ||||||||||||||||||||||||||||||||||||||||||||||||||
201 WVYEEEVFSAYSALWWSPNGTFLAYAQFNDTEVPLIEYSFYSDESLQYPK 250

251 TVRVPYPKAGAVNPTVKFFVVNTDSLSSVTNATSIQITAPASMLIGDHYL 300
    ||||||||||||||||||||||||||||||||||||||||||||||||||
251 TVRVPYPKAGAVNPTVKFFVVNTDSLSSVTNATSIQITAPASMLIGDHYL 300

301 CDVTWATQERISLQWLRRIQNYSVMDICDYDESSGRWNCLVARQHIEMST 350
    ||||||||||||||||||||||||||||||||||||||||||||||||||
301 CDVTWATQERISLQWLRRIQNYSVMDICDYDESSGRWNCLVARQHIEMST 350

351 TGWVGRFRPSEPHFTLDGNSFYKIISNEEGYRHICYFQIDKKDCTFITKG 400
    ||||||||||||||||||||||||||||||||||||||||||||||||||
351 TGWVGRFRPSEPHFTLDGNSFYKIISNEEGYRHICYFQIDKKDCTFITKG 400

401 TWEVIGIEALTSDYLYYISNEYKGMPGGRNLYKIQLSDYTKVTCLSCELN 450
    ||||||||||||||||||||||||||||||||||||||||||||||||||
401 TWEVIGIEALTSDYLYYISNEYKGMPGGRNLYKIQLSDYTKVTCLSCELN 450

451 PERCQYYSVSFSKEAKYYQLRCSGPGLPLYTLHSSVNDKGLRVLEDNSAL 500
    ||||||||||||||||||||||||||||||||||||||||||||||||||
451 PERCQYYSVSFSKEAKYYQLRCSGPGLPLYTLHSSVNDKGLRVLEDNSAL 500

501 DKMLQNVQMPSKKLDFIILNETKFWYQMILPPHFDKSKKYPLLLDVYAGP 550
    ||||||||||||||||||||||||||||||||||||||||||||||||||
501 DKMLQNVQMPSKKLDFIILNETKFWYQMILPPHFDKSKKYPLLLDVYAGP 550

551 CSQKADTVFRLNWATYLASTENIIVASFDGRGSGYQGDKIMHAINRRLGT 600
    ||||||||||||||||||||||||||||||||||||||||||||||||||
551 CSQKADTVFRLNWATYLASTENIIVASFDGRGSGYQGDKIMHAINRRLGT 600

601 FEVEDQIEAARQFSKMGFVDNKRIAIWGWTQCTQNVTWVSQLQKTTLTIT 650
    |||||||||||||||||||||||||||||
601 FEVEDQIEAARQFSKMGFVDNKRIAIWGW..................... 629
```

```
651 EIQQS                                          655
       |
630 ....S                                          630
```

Alignment of HSPCHDP7_Skippingexon_24_P (SEQ ID NO:319) to
DPP4_HUMAN (SEQ ID NO:651)

```
  1 MKTPWKVLLGLLGAAALVTIITVPVVLLNKGTDDATADSRKTYTLTDYLK  50
    ||||||||||||||||||||||||||||||||||||||||||||||||||
  1 MKTPWKVLLGLLGAAALVTIITVPVVLLNKGTDDATADSRKTYTLTDYLK  50

51 NTYRLKLYSLRWISDHEYLYKQENNILVFNAEYGNSSVFLENSTFDEFGH 100
    ||||||||||||||||||||||||||||||||||||||||||||||||||
 51 NTYRLKLYSLRWISDHEYLYKQENNILVFNAEYGNSSVFLENSTFDEFGH 100

101 SINDYSISPDGQFILLEYNYVKQWRHSYTASYDIYDLNKRQLITEERIPN 150
    ||||||||||||||||||||||||||||||||||||||||||||||||||
101 SINDYSISPDGQFILLEYNYVKQWRHSYTASYDIYDLNKRQLITEERIPN 150

151 NTQWVTWSPVGHKLAYVWNNDIYVKIEPNLPSYRITWTGKEDIIYNGITD 200
    ||||||||||||||||||||||||||||||||||||||||||||||||||
151 NTQWVTWSPVGHKLAYVWNNDIYVKIEPNLPSYRITWTGKEDIIYNGITD 200

201 WVYEEEVFSAYSALWWSPNGTFLAYAQFNDTEVPLIEYSFYSDESLQYPK 250
    ||||||||||||||||||||||||||||||||||||||||||||||||||
201 WVYEEEVFSAYSALWWSPNGTFLAYAQFNDTEVPLIEYSFYSDESLQYPK 250

251 TVRVPYPKAGAVNPTVKFFVVNTDSLSSVTNATSIQITAPASMLIGDHYL 300
    ||||||||||||||||||||||||||||||||||||||||||||||||||
251 TVRVPYPKAGAVNPTVKFFVVNTDSLSSVTNATSIQITAPASMLIGDHYL 300

301 CDVTWATQERISLQWLRRIQNYSVMDICDYDESSGRWNCLVARQHIEMST 350
    ||||||||||||||||||||||||||||||||||||||||||||||||||
301 CDVTWATQERISLQWLRRIQNYSVMDICDYDESSGRWNCLVARQHIEMST 350

351 TGWVGRFRPSEPHFTLDGNSFYKIISNEEGYRHICYFQIDKKDCTFITKG 400
    ||||||||||||||||||||||||||||||||||||||||||||||||||
351 TGWVGRFRPSEPHFTLDGNSFYKIISNEEGYRHICYFQIDKKDCTFITKG 400

401 TWEVIGIEALTSDYLYYISNEYKGMPGGRNLYKIQLSDYTKVTCLSCELN 450
    ||||||||||||||||||||||||||||||||||||||||||||||||||
401 TWEVIGIEALTSDYLYYISNEYKGMPGGRNLYKIQLSDYTKVTCLSCELN 450

451 PERCQYYSVSFSKEAKYYQLRCSGPGLPLYTLHSSVNDKGLRVLEDNSAL 500
    ||||||||||||||||||||||||||||||||||||||||||||||||||
451 PERCQYYSVSFSKEAKYYQLRCSGPGLPLYTLHSSVNDKGLRVLEDNSAL 500

501 DKMLQNVQMPSKKLDFIILNETKFWYQMILPPHFDKSKKYPLLLDVYAGP 550
    ||||||||||||||||||||||||||||||||||||||||||||||||||
501 DKMLQNVQMPSKKLDFIILNETKFWYQMILPPHFDKSKKYPLLLDVYAGP 550

551 CSQKADTVFRLNWATYLASTENIIVASFDGRGSGYQGDKIMHAINRRLGT 600
    ||||||||||||||||||||||||||||||||||||||||||||||||||
551 CSQKADTVFRLNWATYLASTENIIVASFDGRGSGYQGDKIMHAINRRLGT 600

601 FEVEDQIEAARQFSKMGFVDNKRIAIWGWSYGGYVTSMVLGSGSGVFKCG 650
    ||||||||||||||||||||||||||||||||||||||||||||||||||
601 FEVEDQIEAARQFSKMGFVDNKRIAIWGWSYGGYVTSMVLGSGSGVFKCG 650
```

```
651 IAVAPVSRWEYYDSVYTERYMGLPTPEDNLDHYRITFTFSSQLRSPKPWS 700
    ||||||||||||||||||||||||||||||||||
651 IAVAPVSRWEYYDSVYTERYMGLPTPEDNLDHYR................ 684

701 MLEWISRQCGILMKTME                                  717

Alignment of HSPCHDP7_Skippingexon_25_P (SEQ ID NO:321) to DPP4_HUMAN (SEQ ID NO:651)

```
  1 MKTPWKVLLGLLGAAALVTIITVPVVLLNKGTDDATADSRKTYTLTDYLK  50
    ||||||||||||||||||||||||||||||||||||||||||||||||||
  1 MKTPWKVLLGLLGAAALVTIITVPVVLLNKGTDDATADSRKTYTLTDYLK  50

51 NTYRLKLYSLRWISDHEYLYKQENNILVFNAEYGNSSVFLENSTFDEFGH 100
    ||||||||||||||||||||||||||||||||||||||||||||||||||
 51 NTYRLKLYSLRWISDHEYLYKQENNILVFNAEYGNSSVFLENSTFDEFGH 100

101 SINDYSISPDGQFILLEYNYVKQWRHSYTASYDIYDLNKRQLITEERIPN 150
    ||||||||||||||||||||||||||||||||||||||||||||||||||
101 SINDYSISPDGQFILLEYNYVKQWRHSYTASYDIYDLNKRQLITEERIPN 150

151 NTQWVTWSPVGHKLAYVWNNDIYVKIEPNLPSYRITWTGKEDIIYNGITD 200
    ||||||||||||||||||||||||||||||||||||||||||||||||||
151 NTQWVTWSPVGHKLAYVWNNDIYVKIEPNLPSYRITWTGKEDIIYNGITD 200

201 WVYEEEVFSAYSALWWSPNGTFLAYAQFNDTEVPLIEYSFYSDESLQYPK 250
    ||||||||||||||||||||||||||||||||||||||||||||||||||
201 WVYEEEVFSAYSALWWSPNGTFLAYAQFNDTEVPLIEYSFYSDESLQYPK 250

251 TVRVPYPKAGAVNPTVKFFVVNTDSLSSVTNATSIQITAPASMLIGDHYL 300
    ||||||||||||||||||||||||||||||||||||||||||||||||||
251 TVRVPYPKAGAVNPTVKFFVVNTDSLSSVTNATSIQITAPASMLIGDHYL 300

301 CDVTWATQERISLQWLRRIQNYSVMDICDYDESSGRWNCLVARQHIEMST 350
    ||||||||||||||||||||||||||||||||||||||||||||||||||
301 CDVTWATQERISLQWLRRIQNYSVMDICDYDESSGRWNCLVARQHIEMST 350

351 TGWVGRFRPSEPHFTLDGNSFYKIISNEEGYRHICYFQIDKKDCTFITKG 400
    ||||||||||||||||||||||||||||||||||||||||||||||||||
351 TGWVGRFRPSEPHFTLDGNSFYKIISNEEGYRHICYFQIDKKDCTFITKG 400

401 TWEVIGIEALTSDYLYYISNEYKGMPGGRNLYKIQLSDYTKVTCLSCELN 450
    ||||||||||||||||||||||||||||||||||||||||||||||||||
401 TWEVIGIEALTSDYLYYISNEYKGMPGGRNLYKIQLSDYTKVTCLSCELN 450

451 PERCQYYSVSFSKEAKYYQLRCSGPGLPLYTLHSSVNDKGLRVLEDNSAL 500
    ||||||||||||||||||||||||||||||||||||||||||||||||||
451 PERCQYYSVSFSKEAKYYQLRCSGPGLPLYTLHSSVNDKGLRVLEDNSAL 500

501 DKMLQNVQMPSKKLDFIILNETKFWYQMILPPHFDKSKKYPLLLDVYAGP 550
    ||||||||||||||||||||||||||||||||||||||||||||||||||
501 DKMLQNVQMPSKKLDFIILNETKFWYQMILPPHFDKSKKYPLLLDVYAGP 550

551 CSQKADTVFRLNWATYLASTENIIVASFDGRGSGYQGDKIMHAINRRLGT 600
    ||||||||||||||||||||||||||||||||||||||||||||||||||
551 CSQKADTVFRLNWATYLASTENIIVASFDGRGSGYQGDKIMHAINRRLGT 600

601 FEVEDQIEAARQFSKMGFVDNKRIAIWGWSYGGYVTSMVLGSGSGVFKCG 650
    ||||||||||||||||||||||||||||||||||||||||||||||||||
601 FEVEDQIEAARQFSKMGFVDNKRIAIWGWSYGGYVTSMVLGSGSGVFKCG 650
```

```
651 IAVAPVSRWEYYDSVYTERYMGLPTPEDNLDHYRNSTVMSRAENFKQVEY 700
    ||||||||||||||||||||||||||||||||||||||||||||||||||
651 IAVAPVSRWEYYDSVYTERYMGLPTPEDNLDHYRNSTVMSRAENFKQVEY 700

701 LLIHGTADVVY                                        711
    ||||||||
701 LLIHGTAD...                                        708
```

Alignment of HSPCHDP7_skippingexon_24_25_P (SEQ ID NO:323) to DPP4_HUMAN (SEQ ID NO:651)

```
  1 MKTPWKVLLGLLGAAALVTIITVPVVLLNKGTDDATADSRKTYTLTDYLK  50
    ||||||||||||||||||||||||||||||||||||||||||||||||||
  1 MKTPWKVLLGLLGAAALVTIITVPVVLLNKGTDDATADSRKTYTLTDYLK  50

51 NTYRLKLYSLRWISDHEYLYKQENNILVFNAEYGNSSVFLENSTFDEFGH 100
    ||||||||||||||||||||||||||||||||||||||||||||||||||
 51 NTYRLKLYSLRWISDHEYLYKQENNILVFNAEYGNSSVFLENSTFDEFGH 100

101 SINDYSISPDGQFILLEYNYVKQWRHSYTASYDIYDLNKRQLITEERIPN 150
    ||||||||||||||||||||||||||||||||||||||||||||||||||
101 SINDYSISPDGQFILLEYNYVKQWRHSYTASYDIYDLNKRQLITEERIPN 150

151 NTQWVTWSPVGHKLAYVWNNDIYVKIEPNLPSYRITWTGKEDIIYNGITD 200
    ||||||||||||||||||||||||||||||||||||||||||||||||||
151 NTQWVTWSPVGHKLAYVWNNDIYVKIEPNLPSYRITWTGKEDIIYNGITD 200

201 WVYEEEVFSAYSALWWSPNGTFLAYAQFNDTEVPLIEYSFYSDESLQYPK 250
    ||||||||||||||||||||||||||||||||||||||||||||||||||
201 WVYEEEVFSAYSALWWSPNGTFLAYAQFNDTEVPLIEYSFYSDESLQYPK 250

251 TVRVPYPKAGAVNPTVKFFVVNTDSLSSVTNATSIQITAPASMLIGDHYL 300
    ||||||||||||||||||||||||||||||||||||||||||||||||||
251 TVRVPYPKAGAVNPTVKFFVVNTDSLSSVTNATSIQITAPASMLIGDHYL 300

301 CDVTWATQERISLQWLRRIQNYSVMDICDYDESSGRWNCLVARQHIEMST 350
    ||||||||||||||||||||||||||||||||||||||||||||||||||
301 CDVTWATQERISLQWLRRIQNYSVMDICDYDESSGRWNCLVARQHIEMST 350

351 TGWVGRFRPSEPHFTLDGNSFYKIISNEEGYRHICYFQIDKKDCTFITKG 400
    ||||||||||||||||||||||||||||||||||||||||||||||||||
351 TGWVGRFRPSEPHFTLDGNSFYKIISNEEGYRHICYFQIDKKDCTFITKG 400

401 TWEVIGIEALTSDYLYYISNEYKGMPGGRNLYKIQLSDYTKVTCLSCELN 450
    ||||||||||||||||||||||||||||||||||||||||||||||||||
401 TWEVIGIEALTSDYLYYISNEYKGMPGGRNLYKIQLSDYTKVTCLSCELN 450

451 PERCQYYSVSFSKEAKYYQLRCSGPGLPLYTLHSSVNDKGLRVLEDNSAL 500
    ||||||||||||||||||||||||||||||||||||||||||||||||||
451 PERCQYYSVSFSKEAKYYQLRCSGPGLPLYTLHSSVNDKGLRVLEDNSAL 500
```

```
501 DKMLQNVQMPSKKLDFIILNETKFWYQMILPPHFDKSKKYPLLLDVYAGP 550
    |||||||||||||||||||||||||||||||||||||||||||||||||
501 DKMLQNVQMPSKKLDFIILNETKFWYQMILPPHFDKSKKYPLLLDVYAGP 550

551 CSQKADTVFRLNWATYLASTENIIVASFDGRGSGYQGDKIMHAINRRLGT 600
    |||||||||||||||||||||||||||||||||||||||||||||||||
551 CSQKADTVFRLNWATYLASTENIIVASFDGRGSGYQGDKIMHAINRRLGT 600

601 FEVEDQIEAARQFSKMGFVDNKRIAIWGWSYGGYVTSMVLGSGSGVFKCG 650
    |||||||||||||||||||||||||||||||||||||||||||||||||
601 FEVEDQIEAARQFSKMGFVDNKRIAIWGWSYGGYVTSMVLGSGSGVFKCG 650

651 IAVAPVSRWEYYDSVYTERYMGLPTPEDNLDHYR................ 684
    |||||||||||||||||||||||||||||||||
651 IAVAPVSRWEYYDSVYTERYMGLPTPEDNLDHYRNSTVMSRAENFKQVEY 700

685 ................................WYTDEDHGIASSTAHQH 701
                                    |||||||||||||||||
701 LLIHGTADDNVHFQQSAQISKALVDVGVDFQAMWYTDEDHGIASSTAHQH 750

702 IYTHMSHFIKQCFSLP                                   717
    ||||||||||||||||
751 IYTHMSHFIKQCFSLP                                   766
```

Figure 145

Alignment of: D12020_P5 (SEQ ID NO:367) x TFPI_HUMAN (SEQ ID NO:370) ..

```
 32 QADDGPCKAIMKRFFFNIFTRQCEEFIYGGCEGNQNRFESLEECKKMCTR  81
    :|||||||||||||||||||||||||||||||||||||||||||||||||
 57 KADDGPCKAIMKRFFFNIFTRQCEEFIYGGCEGNQNRFESLEECKKMCTR 106

82 DNANRIIKTTLQQEKPDFCFLEEDPGICRGYITRYFYNNQTKQCERFKYG 131
    |||||||||||||||||||||||||||||||||||||||||||||||||
107 DNANRIIKTTLQQEKPDFCFLEEDPGICRGYITRYFYNNQTKQCERFKYG 156

132 GCLGNMNNFETLEECKNICEDGPNGFQVDNYGTQLNAVNNSLTPQSTKVP 181
    |||||||||||||||||||||||||||||||||||||||||||||||||
157 GCLGNMNNFETLEECKNICEDGPNGFQVDNYGTQLNAVNNSLTPQSTKVP 206

182 SLFEFHGPSWCLTPADRGLCRANENRFYYNSVIGKCRPFKYSGCGGNENN 231
    |||||||||||||||||||||||||||||||||||||||||||||||||
207 SLFEFHGPSWCLTPADRGLCRANENRFYYNSVIGKCRPFKYSGCGGNENN 256

232 FTSKQECLRACKKGFIQRISKGGLIKTKRKRKKQRVKIAYEEIFVKNM   279
    |||||||||||||||||||||||||||||||||||||||||||||||
257 FTSKQECLRACKKGFIQRISKGGLIKTKRKRKKQRVKIAYEEIFVKNM   304
```

Figure 146

Alignment of: D12020_P10 (SEQ ID NO:368) x TFPI_HUMAN (SEQ ID NO:370) ..

```
  1 MIYTMKKVHALWASVCLLLNLAPAPLNADSEEDEEHTIITDTELPPLKLM  50
    |||||||||||||||||||||||||||||||||||||||||||||||||
  1 MIYTMKKVHALWASVCLLLNLAPAPLNADSEEDEEHTIITDTELPPLKLM  50

51 HSFCAFKADDGPCKAIMKRFFFNIFTRQCEEFIYGGCEGNQNRFESLEEC 100
    |||||||||||||||||||||||||||||||||||||||||||||||||
 51 HSFCAFKADDGPCKAIMKRFFFNIFTRQCEEFIYGGCEGNQNRFESLEEC 100

101 KKMCTRDNANRIIKTTLQQEKPDFCFLEEDPGICRGYITRYFYNNQTKQC 150
    |||||||||||||||||||||||||||||||||||||||||||||||||
101 KKMCTRDNANRIIKTTLQQEKPDFCFLEEDPGICRGYITRYFYNNQTKQC 150

151 ERFKYGGCLGNMNNFETLEECKNICEDGPNGFQVDNYGTQLNAVNNSLTP 200
    |||||||||||||||||||||||||||||||||||||||||||||||||
151 ERFKYGGCLGNMNNFETLEECKNICEDGPNGFQVDNYGTQLNAVNNSLTP 200

201 QSTKVPSLF                                         209
    |||||||||
201 QSTKVPSLF                                         209
```

Figure 147

Alignment of: D12020_P11 (SEQ ID NO:369) x TFPI_HUMAN (SEQ ID NO:370) ..

```
  1 MIYTMKKVHALWASVCLLLNLAPAPLNADSEEDEEHTIITDTELPPLKLM  50
    ||||||||||||||||||||||||||||||||||||||||||||||||||
  1 MIYTMKKVHALWASVCLLLNLAPAPLNADSEEDEEHTIITDTELPPLKLM  50

51 HSFCAFKADDGPCKAIMKRFFFNIFTRQCEEFIYGGCEGNQNRFESLEEC 100
    ||||||||||||||||||||||||||||||||||||||||||||||||||
 51 HSFCAFKADDGPCKAIMKRFFFNIFTRQCEEFIYGGCEGNQNRFESLEEC 100

101 KKMCTR                                             106
    ||||||
101 KKMCTR                                             106
```

Figure 148

Alignment of: HSEGF01_PEA_1_P11(SEQ ID NO:423) x EGFR_HUMAN(SEQ ID NO:427)

```
  1 MRPSGTAGAALLALLAALCPASRALEEKKVCQGTSNKLTQLGTFEDHFLS  50
    ||||||||||||||||||||||||||||||||||||||||||||||||||
  1 MRPSGTAGAALLALLAALCPASRALEEKKVCQGTSNKLTQLGTFEDHFLS  50

51 LQRMFNNCEVVLGNLEITYVQRNYDLSFLKTIQEVAGYVLIALNTVERIP 100
    ||||||||||||||||||||||||||||||||||||||||||||||||||
 51 LQRMFNNCEVVLGNLEITYVQRNYDLSFLKTIQEVAGYVLIALNTVERIP 100

101 LENLQIIRGNMYYENSYALAVLSNYDANKTGLKELPMRNLQEILHGAVRF 150
    ||||||||||||||||||||||||||||||||||||||||||||||||||
101 LENLQIIRGNMYYENSYALAVLSNYDANKTGLKELPMRNLQEILHGAVRF 150

151 SNNPALCNVESIQWRDIVSSDFLSNMSMDFQNHLGSCQKCDPSCPNGSCW 200
    ||||||||||||||||||||||||||||||||||||||||||||||||||
151 SNNPALCNVESIQWRDIVSSDFLSNMSMDFQNHLGSCQKCDPSCPNGSCW 200

201 GAGEENCQKLTKIICAQQCSGRCRGKSPSDCCHNQCAAGCTGPRESDCLV 250
    ||||||||||||||||||||||||||||||||||||||||||||||||||
201 GAGEENCQKLTKIICAQQCSGRCRGKSPSDCCHNQCAAGCTGPRESDCLV 250

251 CRKFRDEATCKDTCPPLMLYNPTTYQMDVNPEGKYSFGATCVKKCPRNYV 300
    ||||||||||||||||||||||||||||||||||||||||||||||||||
251 CRKFRDEATCKDTCPPLMLYNPTTYQMDVNPEGKYSFGATCVKKCPRNYV 300

301 VTDHGSCVRACGADSYEMEEDGVRKCKKCEGPCRKVCNGIGIGEFKDSLS 350
    ||||||||||||||||||||||||||||||||||||||||||||||||||
301 VTDHGSCVRACGADSYEMEEDGVRKCKKCEGPCRKVCNGIGIGEFKDSLS 350

351 INATNIKHFKNCTSISGDLHILPVAFRGDSFTHTPPLDPQELDILKTVKE 400
    ||||||||||||||||||||||||||||||||||||||||||||||||||
351 INATNIKHFKNCTSISGDLHILPVAFRGDSFTHTPPLDPQELDILKTVKE 400

401 ITGFLLIQAWPENRTDLHAFENLEIIRGRTKQHGQFSLAVVSLNITSLGL 450
    ||||||||||||||||||||||||||||||||||||||||||||||||||
401 ITGFLLIQAWPENRTDLHAFENLEIIRGRTKQHGQFSLAVVSLNITSLGL 450

451 RSLKEISDGDVIISGNKNLCYANTINWKKLFGTSGQKTKIISNRGENSCK 500
    ||||||||||||||||||||||||||||||||||||||||||||||||||
451 RSLKEISDGDVIISGNKNLCYANTINWKKLFGTSGQKTKIISNRGENSCK 500

501 ATGQVCHALCSPEGCWGPEPRDCVSCRNVSRGRECVDKCNLLEGEPREFV 550
    ||||||||||||||||||||||||||||||||||||||||||||||||||
501 ATGQVCHALCSPEGCWGPEPRDCVSCRNVSRGRECVDKCNLLEGEPREFV 550

551 ENSECIQCHPECLPQAMNITCTGRGPDNCIQCAHYIDGPHCVKTCPAGVM 600
    ||||||||||||||||||||||||||||||||||||||||||||||||||
551 ENSECIQCHPECLPQAMNITCTGRGPDNCIQCAHYIDGPHCVKTCPAGVM 600

601 GENNTLVWKYADAGHVCHLCHPNCTYG                        627
    |||||||||||||||||||||||||||
601 GENNTLVWKYADAGHVCHLCHPNCTYG                        627
```

Figure 149

Alignment of: HSEGF01_PEA_1_P14(SEQ ID NO:424) x EGFR_HUMAN (SEQ ID NO:427)..

```
  1 MRPSGTAGAALLALLAALCPASRALEEKKVCQGTSNKLTQLGTFEDHFLS  50
    |||||||||||||||||||||||||||||||||||||||||||||||||
  1 MRPSGTAGAALLALLAALCPASRALEEKKVCQGTSNKLTQLGTFEDHFLS  50

51 LQRMFNNCEVVLGNLEITYVQRNYDLSFLKTIQEVAGYVLIALNTVERIP 100
    |||||||||||||||||||||||||||||||||||||||||||||||||
 51 LQRMFNNCEVVLGNLEITYVQRNYDLSFLKTIQEVAGYVLIALNTVERIP 100

101 LENLQIIRGNMYYENSYALAVLSNYDANKTGLKELPMRNLQEILHGAVRF 150
    |||||||||||||||||||||||||||||||||||||||||||||||||
101 LENLQIIRGNMYYENSYALAVLSNYDANKTGLKELPMRNLQEILHGAVRF 150

151 SNNPALCNVESIQWRDIVSSDFLSNMSMDFQNHLGSCQKCDPSCPNGSCW 200
    |||||||||||||||||||||||||||||||||||||||||||||||||
151 SNNPALCNVESIQWRDIVSSDFLSNMSMDFQNHLGSCQKCDPSCPNGSCW 200

201 GAGEENCQKLTKIICAQQCSGRCRGKSPSDCCHNQCAAGCTGPRESDCLV 250
    |||||||||||||||||||||||||||||||||||||||||||||||||
201 GAGEENCQKLTKIICAQQCSGRCRGKSPSDCCHNQCAAGCTGPRESDCLV 250

251 CRKFRDEATCKDTCPPLMLYNPTTYQMDVNPEGKYSFGATCVKKCPR    297
    ||||||||||||||||||||||||||||||||||||||||||||||
251 CRKFRDEATCKDTCPPLMLYNPTTYQMDVNPEGKYSFGATCVKKCPR    297
```

Figure 150

Alignment of: HSEGF01_PEA_1_P18(SEQ ID NO:425) x EGFR_HUMAN (SEQ ID NO:427)..

```
  1 MRPSGTAGAALLALLAALCPASRALEEKKVCQGTSNKLTQLGTFEDHFLS  50
    |||||||||||||||||||||||||||||||||||||||||||||||||
  1 MRPSGTAGAALLALLAALCPASRALEEKKVCQGTSNKLTQLGTFEDHFLS  50

51 LQRMFNNCEVVLGNLEITYVQRNYDLSFLKTIQEVAGYVLIALNTVERIP 100
    |||||||||||||||||||||||||||||||||||||||||||||||||
 51 LQRMFNNCEVVLGNLEITYVQRNYDLSFLKTIQEVAGYVLIALNTVERIP 100

101 LENLQIIRGNMYYENSYALAVLSNYDANKTGLKELPMRNLQEILHGAVRF 150
    |||||||||||||||||||||||||||||||||||||||||||||||||
101 LENLQIIRGNMYYENSYALAVLSNYDANKTGLKELPMRNLQEILHGAVRF 150

151 SNNPALCNVESIQWRDIVSSDFLSNMSMDFQNHLGSCK             188
    ||||||||||||||||||||||||||||||||||||:
151 SNNPALCNVESIQWRDIVSSDFLSNMSMDFQNHLGSCQ             188
```

Figure 151

Alignment of: HSEGF01_PEA_1_P24(SEQ ID NO:426) x EGFR_HUMAN (SEQ ID NO:427)..

```
  1 MRPSGTAGAALLALLAALCPASRALEEKKVCQGTSNKLTQLGTFEDHFLS  50
    ||||||||||||||||||||||||||||||||||||||||||||||||||
  1 MRPSGTAGAALLALLAALCPASRALEEKKVCQGTSNKLTQLGTFEDHFLS  50

51 LQRMFNNCEVVLGNLEITYVQRNYDLSFLKTIQEVAGYVLIALNTVERIP 100
    ||||||||||||||||||||||||||||||||||||||||||||||||||
 51 LQRMFNNCEVVLGNLEITYVQRNYDLSFLKTIQEVAGYVLIALNTVERIP 100

101 LENLQIIRGNMYYENSYALAVLSNYDANKTGLKELPMRNLQEILHGAVRF 150
    ||||||||||||||||||||||||||||||||||||||||||||||||||
101 LENLQIIRGNMYYENSYALAVLSNYDANKTGLKELPMRNLQEILHGAVRF 150

151 SNNPALCNVESIQWRDIVSSDFLSNMSMDFQNHLGSCQKCDPSCPNGSCW 200
    ||||||||||||||||||||||||||||||||||||||||||||||||||
151 SNNPALCNVESIQWRDIVSSDFLSNMSMDFQNHLGSCQKCDPSCPNGSCW 200

201 GAGEENCQKLTKIICAQQCSGRCRGKSPSDCCHNQCAAGCTGPRESDCLV 250
    ||||||||||||||||||||||||||||||||||||||||||||||||||
201 GAGEENCQKLTKIICAQQCSGRCRGKSPSDCCHNQCAAGCTGPRESDCLV 250

251 CRKFRDEATCKDTCPPLMLYNPTTYQMDVNPEGKYSFGATCVKKCPRNYV 300
    ||||||||||||||||||||||||||||||||||||||||||||||||||
251 CRKFRDEATCKDTCPPLMLYNPTTYQMDVNPEGKYSFGATCVKKCPRNYV 300

301 VTDHGSCVRACGADSYEMEEDGVRKCKKCEGPCRK                335
    |||||||||||||||||||||||||||||||||||
301 VTDHGSCVRACGADSYEMEEDGVRKCKKCEGPCRK                335
```

Figure 152

Alignment of: HUMEGFAA_PEA_2_P3 (SEQ ID NO:495) x VEGA_HUMAN (SEQ ID NO:196) ..

```
  1 MNFLLSWVHWSLALLLYLHHAKWSQAAPMAEGGGQNHHEVVKFMDVYQRS  50
    ||||||||||||||||||||||||||||||||||||||||||||||||||
  1 MNFLLSWVHWSLALLLYLHHAKWSQAAPMAEGGGQNHHEVVKFMDVYQRS  50

51 YCHPIETLVDIFQEYPDEIEYIFKPSCVPLMRCGGCCNDEGLECVPTEES 100
    ||||||||||||||||||||||||||||||||||||||||||||||||||
 51 YCHPIETLVDIFQEYPDEIEYIFKPSCVPLMRCGGCCNDEGLECVPTEES 100

101 NITMQ                                              105
    |||||
101 NITMQ                                              105
```

Figure 153

Alignment of: HUMEGFAA_PEA_2_P14 (SEQ ID NO:496)x VEGA_HUMAN (SEQ ID NO:196) ..

```
  1 MNFLLSWVHWSLALLLYLHHAKWSQAAPMAEGGGQNHHEVVKFMDVYQRS  50
    ||||||||||||||||||||||||||||||||||||||||||||||||||
  1 MNFLLSWVHWSLALLLYLHHAKWSQAAPMAEGGGQNHHEVVKFMDVYQRS  50

51 YCHPIETLVDIFQEYPDEIEYIFKPSCVPLMRCGGCCNDEGLECVPTEES 100
    ||||||||||||||||||||||||||||||||||||||||||||||||||
 51 YCHPIETLVDIFQEYPDEIEYIFKPSCVPLMRCGGCCNDEGLECVPTEES 100

101 NITMQIMRIKPHQGQHIGEMSFLQHNKCECR                    131
    ||||||||||||||||||||||||||||||||
101 NITMQIMRIKPHQGQHIGEMSFLQHNKCECR                    131
```

Figure 154

Alignment of: HSFLT_PEA_1_P3 (SEQ ID NO:531) x VGR1_HUMAN (SEQ ID NO:530)

```
  1 MVSYWDTGVLLCALLSCLLLTGSSSGSKLKDPELSLKGTQHIMQAGQTLH  50
    ||||||||||||||||||||||||||||||||||||||||||||||||||
  1 MVSYWDTGVLLCALLSCLLLTGSSSGSKLKDPELSLKGTQHIMQAGQTLH  50

51 LQCRGEAAHKWSLPEMVSKESERLSITKSACGRNGKQFCSTLTLNTAQAN 100
    ||||||||||||||||||||||||||||||||||||||||||||||||||
 51 LQCRGEAAHKWSLPEMVSKESERLSITKSACGRNGKQFCSTLTLNTAQAN 100

101 HTGFYSCKYLAVPTSKKKETESAIYIFISDTGRPFVEMYSEIPEIIHMTE 150
    ||||||||||||||||||||||||||||||||||||||||||||||||||
101 HTGFYSCKYLAVPTSKKKETESAIYIFISDTGRPFVEMYSEIPEIIHMTE 150

151 GRELVIPCRVTSPNITVTLKKFPLDTLIPDGKRIIWDSRKGFIISNATYK 200
    ||||||||||||||||||||||||||||||||||||||||||||||||||
151 GRELVIPCRVTSPNITVTLKKFPLDTLIPDGKRIIWDSRKGFIISNATYK 200

201 EIGLLTCEATVNGHLYKTNYLTHRQTNTIIDVQISTPRPVKLLRGHTLVL 250
    ||||||||||||||||||||||||||||||||||||||||||||||||||
201 EIGLLTCEATVNGHLYKTNYLTHRQTNTIIDVQISTPRPVKLLRGHTLVL 250

251 NCTATTPLNTRVQMTWSYPDEKNKRASVRRRIDQSNSHANIFYSVLTIDK 300
    ||||||||||||||||||||||||||||||||||||||||||||||||||
251 NCTATTPLNTRVQMTWSYPDEKNKRASVRRRIDQSNSHANIFYSVLTIDK 300

301 MQNKDKGLYTCRVRSGPSFKSVNTSVHIYDKAFITVKHRKQQVLETVAGK 350
    ||||||||||||||||||||||||||||||||||||||||||||||||||
301 MQNKDKGLYTCRVRSGPSFKSVNTSVHIYDKAFITVKHRKQQVLETVAGK 350

351 RSYRLSMKVKAFPSPEVVWLKDGLPATEKSARYLTRGYSLIIKDVTEEDA 400
    ||||||||||||||||||||||||||||||||||||||||||||||||||
351 RSYRLSMKVKAFPSPEVVWLKDGLPATEKSARYLTRGYSLIIKDVTEEDA 400

401 GNYTILLSIKQSNVFKNLTATLIVNVKPQIYEKAVSSFPDPALYPLGSRQ 450
    ||||||||||||||||||||||||||||||||||||||||||||||||||
401 GNYTILLSIKQSNVFKNLTATLIVNVKPQIYEKAVSSFPDPALYPLGSRQ 450

451 ILTCTAYGIPQPTIKWFWHPCNHNHSEARCDFCSNNEESFILDADSNMGN 500
    ||||||||||||||||||||||||||||||||||||||||||||||||||
451 ILTCTAYGIPQPTIKWFWHPCNHNHSEARCDFCSNNEESFILDADSNMGN 500

501 RIESITQRMAIIEGKNKMASTLVVADSRISGIYICIASNKVGTVGRNISF 550
    ||||||||||||||||||||||||||||||||||||||||||||||||||
501 RIESITQRMAIIEGKNKMASTLVVADSRISGIYICIASNKVGTVGRNISF 550

551 YITELSN 557
    |||::|
551 YITDVPN 557
```

Figure 155

Alignment of: HSFLT_PEA_1_P4 (SEQ ID NO:532) x VGR1_HUMAN (SEQ ID NO:530)

```
  1 MVSYWDTGVLLCALLSCLLLTGSSSGSKLKDPELSLKGTQHIMQAGQTLH  50
    ||||||||||||||||||||||||||||||||||||||||||||||||||
  1 MVSYWDTGVLLCALLSCLLLTGSSSGSKLKDPELSLKGTQHIMQAGQTLH  50

51 LQCRGEAAHKWSLPEMVSKESERLSITKSACGRNGKQFCSTLTLNTAQAN 100
    ||||||||||||||||||||||||||||||||||||||||||||||||||
 51 LQCRGEAAHKWSLPEMVSKESERLSITKSACGRNGKQFCSTLTLNTAQAN 100

101 HTGFYSCKYLAVPTSKKKETESAIYIFISDTGRPFVEMYSEIPEIIHMTE 150
    ||||||||||||||||||||||||||||||||||||||||||||||||||
101 HTGFYSCKYLAVPTSKKKETESAIYIFISDTGRPFVEMYSEIPEIIHMTE 150

151 GRELVIPCRVTSPNITVTLKKFPLDTLIPDGKRIIWDSRKGFIISNATYK 200
    ||||||||||||||||||||||||||||||||||||||||||||||||||
151 GRELVIPCRVTSPNITVTLKKFPLDTLIPDGKRIIWDSRKGFIISNATYK 200

201 EIGLLTCEATVNGHLYKTNYLTHRQTNTIIDVQISTPRPVKLLRGHTLVL 250
    ||||||||||||||||||||||||||||||||||||||||||||||||||
201 EIGLLTCEATVNGHLYKTNYLTHRQTNTIIDVQISTPRPVKLLRGHTLVL 250

251 NCTATTPLNTRVQMTWSYPDEKNKRASVRRRIDQSNSHANIFYSVLTIDK 300
    ||||||||||||||||||||||||||||||||||||||||||||||||||
251 NCTATTPLNTRVQMTWSYPDEKNKRASVRRRIDQSNSHANIFYSVLTIDK 300

301 MQNKDKGLYTCRVRSGPSFKSVNTSVHIYDKAFITVKHRKQQVLETVAGK 350
    ||||||||||||||||||||||||||||||||||||||||||||||||||
301 MQNKDKGLYTCRVRSGPSFKSVNTSVHIYDKAFITVKHRKQQVLETVAGK 350

351 RSYRLSMKVKAFPSPEVVWLKDGLPATEKSARYLTRGYSLIIKDVTEEDA 400
    ||||||||||||||||||||||||||||||||||||||||||||||||||
351 RSYRLSMKVKAFPSPEVVWLKDGLPATEKSARYLTRGYSLIIKDVTEEDA 400

401 GNYTILLSIKQSNVFKNLTATLIVNVKPQIYEKAVSSFPDPALYPLGSRQ 450
    ||||||||||||||||||||||||||||||||||||||||||||||||||
401 GNYTILLSIKQSNVFKNLTATLIVNVKPQIYEKAVSSFPDPALYPLGSRQ 450

451 ILTCTAYGIPQPTIKWFWHPCNHNHSEARCDFCSNNEESFILDADSNMGN 500
    ||||||||||||||||||||||||||||||||||||||||||||||||||
451 ILTCTAYGIPQPTIKWFWHPCNHNHSEARCDFCSNNEESFILDADSNMGN 500

501 RIESITQRMAIIEGKNKL                                 518
    ||||||||||||||||||:
501 RIESITQRMAIIEGKNKM                                 518
```

Alignment of: HSFLT_PEA_1_P10 (SEQ ID NO:533) x VGR1_HUMAN (SEQ ID NO:530)

```
  1 MVSYWDTGVLLCALLSCLLLTGSSSGSKLKDPELSLKGTQHIMQAGQTLH  50
    ||||||||||||||||||||||||||||||||||||||||||||||||||
  1 MVSYWDTGVLLCALLSCLLLTGSSSGSKLKDPELSLKGTQHIMQAGQTLH  50

51 LQCRGEAAHKWSLPEMVSKESERLSITKSACGRNGKQFCSTLTLNTAQAN 100
    ||||||||||||||||||||||||||||||||||||||||||||||||||
 51 LQCRGEAAHKWSLPEMVSKESERLSITKSACGRNGKQFCSTLTLNTAQAN 100

101 HTGFYSCKYLAVPTSKKKETESAIYIFISDTGRPFVEMYSEIPEIIHMTE 150
    ||||||||||||||||||||||||||||||||||||||||||||||||||
101 HTGFYSCKYLAVPTSKKKETESAIYIFISDTGRPFVEMYSEIPEIIHMTE 150

151 GRELVIPCRVTSPNITVTLKKFPLDTLIPDGKRIIWDSRKGFIISNATYK 200
    ||||||||||||||||||||||||||||||||||||||||||||||||||
151 GRELVIPCRVTSPNITVTLKKFPLDTLIPDGKRIIWDSRKGFIISNATYK 200

201 EIGLLTCEATVNGHLYKTNYLTHRQTNTIIDVQISTPRPVKLLRGHTLVL 250
    ||||||||||||||||||||||||||||||||||||||||||||||||||
201 EIGLLTCEATVNGHLYKTNYLTHRQTNTIIDVQISTPRPVKLLRGHTLVL 250

251 NCTATTPLNTRVQMTWSYPDEKNKRASVRRRIDQSNSHANIFYSVLTIDK 300
    ||||||||||||||||||||||||||||||||||||||||||||||||||
251 NCTATTPLNTRVQMTWSYPDEKNKRASVRRRIDQSNSHANIFYSVLTIDK 300

301 MQNKDKGLYTCRVRSGPSFKSVNTSVHIYDKAFITVKHRKQQVLETVAGK 350
    ||||||||||||||||||||||||||||||||||||||||||||||||||
301 MQNKDKGLYTCRVRSGPSFKSVNTSVHIYDKAFITVKHRKQQVLETVAGK 350

351 RSYRLSMKVKAFPSPEVVWLKDGLPATEKSARYLTRGYSLIIKDVTEEDA 400
    ||||||||||||||||||||||||||||||||||||||||||||||||||
351 RSYRLSMKVKAFPSPEVVWLKDGLPATEKSARYLTRGYSLIIKDVTEEDA 400

401 GNYTILLSIKQSNVFKNLTATLIVNVKPQIYEKAVSSFPDPALYPLGSRQ 450
    ||||||||||||||||||||||||||||||||||||||||||||||||||
401 GNYTILLSIKQSNVFKNLTATLIVNVKPQIYEKAVSSFPDPALYPLGSRQ 450

451 ILTCTAYGIPQPTIKWFWHPCNHNHSEARCDFCSNNEESFILDADSNMGN 500
    ||||||||||||||||||||||||||||||||||||||||||||||||||
451 ILTCTAYGIPQPTIKWFWHPCNHNHSEARCDFCSNNEESFILDADSNMGN 500

501 RIESITQRMAIIEGKNKMASTLVVADSRISGIYICIASNKVGTVGRNISF 550
    ||||||||||||||||||||||||||||||||||||||||||||||||||
501 RIESITQRMAIIEGKNKMASTLVVADSRISGIYICIASNKVGTVGRNISF 550

551 YITDVPNGFHVNLEKMPTEGEDLKLSCTVNKFLYRDVTWILLRTVNNRTM 600
    ||||||||||||||||||||||||||||||||||||||||||||||||||
551 YITDVPNGFHVNLEKMPTEGEDLKLSCTVNKFLYRDVTWILLRTVNNRTM 600

601 HYSISKQKMAITKEHSITLNLTIMNVSLQDSGTYACRARNVYTGEEILQK 650
    ||||||||||||||||||||||||||||||||||||||||||||||||||
601 HYSISKQKMAITKEHSITLNLTIMNVSLQDSGTYACRARNVYTGEEILQK 650

651 KEITIRDQEAPYLLRNLSDHTVAISSSTTLDCHANGVPEPQITWFKNNHK 700
    ||||||||||||||||||||||||||||||||||||||||||||||||||
651 KEITIRDQEAPYLLRNLSDHTVAISSSTTLDCHANGVPEPQITWFKNNHK 700
```

```
701 IQQEP                                           705
    |||||
701 IQQEP                                           705
```

Alignment of: HSFLT_PEA_1_P12 (SEQ ID NO:534) x VGR1_HUMAN (SEQ ID NO:530)

```
  1 MVSYWDTGVLLCALLSCLLLTGSSSGSKLKDPELSLKGTQHIMQAGQTLH  50
    ||||||||||||||||||||||||||||||||||||||||||||||||||
  1 MVSYWDTGVLLCALLSCLLLTGSSSGSKLKDPELSLKGTQHIMQAGQTLH  50

51 LQCRGEAAHKWSLPEMVSKESERLSITKSACGRNGKQFCSTLTLNTAQAN 100
    ||||||||||||||||||||||||||||||||||||||||||||||||||
 51 LQCRGEAAHKWSLPEMVSKESERLSITKSACGRNGKQFCSTLTLNTAQAN 100

101 HTGFYSCKYLAVPTSKKKETESAIYIFISDTGRPFVEMYSEIPEIIHMTE 150
    ||||||||||||||||||||||||||||||||||||||||||||||||||
101 HTGFYSCKYLAVPTSKKKETESAIYIFISDTGRPFVEMYSEIPEIIHMTE 150

151 GRELVIPCRVTSPNITVTLKKFPLDTLIPDGKRIIWDSRKGFIISNATYK 200
    ||||||||||||||||||||||||||||||||||||||||||||||||||
151 GRELVIPCRVTSPNITVTLKKFPLDTLIPDGKRIIWDSRKGFIISNATYK 200

201 EIGLLTCEATVNGHLYKTNYLTHRQTNTIIDVQISTPRPVKLLRGHTLVL 250
    ||||||||||||||||||||||||||||||||||||||||||||||||||
201 EIGLLTCEATVNGHLYKTNYLTHRQTNTIIDVQISTPRPVKLLRGHTLVL 250

251 NCTATTPLNTRVQMTWSYPDEKNKRASVRRRIDQSNSHANIFYSVLTIDK 300
    ||||||||||||||||||||||||||||||||||||||||||||||||||
251 NCTATTPLNTRVQMTWSYPDEKNKRASVRRRIDQSNSHANIFYSVLTIDK 300

301 MQNKDKGLYTCRVRSGPSFKSVNTSVHIYDKAFITVKHRKQQVLETVAGK 350
    ||||||||||||||||||||||||||||||||||||||||||||||||||
301 MQNKDKGLYTCRVRSGPSFKSVNTSVHIYDKAFITVKHRKQQVLETVAGK 350

351 RSYRLSMKVKAFPSPEVVWLKDGLPATEKSARYLTRGYSLIIKDVTEEDA 400
    ||||||||||||||||||||||||||||||||||||||||||||||||||
351 RSYRLSMKVKAFPSPEVVWLKDGLPATEKSARYLTRGYSLIIKDVTEEDA 400

401 GNYTILLSIKQSNVFKNLTATLIVNVKPQIYEKAVSSFPDPALYPLGSRQ 450
    ||||||||||||||||||||||||||||||||||||||||||||||||||
401 GNYTILLSIKQSNVFKNLTATLIVNVKPQIYEKAVSSFPDPALYPLGSRQ 450

451 ILTCTAYGIPQPTIKWFWHPCNHNHSEARCDFCSNNEESFILDADSNMGN 500
    ||||||||||||||||||||||||||||||||||||||||||||||||||
451 ILTCTAYGIPQPTIKWFWHPCNHNHSEARCDFCSNNEESFILDADSNMGN 500
```

```
501 RIESITQRMAIIEGKNKMASTLVVADSRISGIYICIASNKVGTVGRNISF 550
    |||||||||||||||||||||||||||||||||||||||||||||||||
501 RIESITQRMAIIEGKNKMASTLVVADSRISGIYICIASNKVGTVGRNISF 550

551 YITDVPNGFHVNLEKMPTEGEDLKLSCTVNKFLYRDVTWILLRTVNNRTM 600
    |||||||||||||||||||||||||||||||||||||||||||||||||
551 YITDVPNGFHVNLEKMPTEGEDLKLSCTVNKFLYRDVTWILLRTVNNRTM 600

601 HYSISKQKMAITKEHSITLNLTIMNVSLQDSGTYACRARNVYTGEEILQK 650
    |||||||||||||||||||||||||||||||||||||||||||||||||
601 HYSISKQKMAITKEHSITLNLTIMNVSLQDSGTYACRARNVYTGEEILQK 650

651 KEITIRDQEAPYLLRNLSDHTVAISSSTTLDCHANGVPEPQITWFKNNHK 700
    |||||||||||||||||||||||||||||||||||||||||||||||||
651 KEITIRDQEAPYLLRNLSDHTVAISSSTTLDCHANGVPEPQITWFKNNHK 700

701 IQQEPG                                             706
    ||||||
701 IQQEPG                                             706
```

```
Alignment of: HSFLT_PEA_1_P13 (SEQ ID NO:535) x VGR1_HUMAN (SEQ
ID NO:530)

1 MVSYWDTGVLLCALLSCLLLTGSSSGSKLKDPELSLKGTQHIMQAGQTLH  50
    ||||||||||||||||||||||||||||||||||||||||||||||||||
  1 MVSYWDTGVLLCALLSCLLLTGSSSGSKLKDPELSLKGTQHIMQAGQTLH  50

51 LQCRGEAAHKWSLPEMVSKESERLSITKSACGRNGKQFCSTLTLNTAQAN 100
    ||||||||||||||||||||||||||||||||||||||||||||||||||
 51 LQCRGEAAHKWSLPEMVSKESERLSITKSACGRNGKQFCSTLTLNTAQAN 100

101 HTGFYSCKYLAVPTSKKKETESAIYIFISDTGRPFVEMYSEIPEIIHMTE 150
    ||||||||||||||||||||||||||||||||||||||||||||||||||
101 HTGFYSCKYLAVPTSKKKETESAIYIFISDTGRPFVEMYSEIPEIIHMTE 150

151 GRELVIPCRVTSPNITVTLKKFPLDTLIPDGKRIIWDSRKGFIISNATYK 200
    ||||||||||||||||||||||||||||||||||||||||||||||||||
151 GRELVIPCRVTSPNITVTLKKFPLDTLIPDGKRIIWDSRKGFIISNATYK 200

201 EIGLLTCEATVNGHLYKTNYLTHRQTNTIIDVQISTPRPVKLLRGHTLVL 250
    ||||||||||||||||||||||||||||||||||||||||||||||||||
201 EIGLLTCEATVNGHLYKTNYLTHRQTNTIIDVQISTPRPVKLLRGHTLVL 250

251 NCTATTPLNTRVQMTWSYPDEKNKRASVRRRIDQSNSHANIFYSVLTIDK 300
    ||||||||||||||||||||||||||||||||||||||||||||||||||
251 NCTATTPLNTRVQMTWSYPDEKNKRASVRRRIDQSNSHANIFYSVLTIDK 300

301 MQNKDKGLYTCRVRSGPSFKSVNTSVHIYDKAFITVKHRKQQVLETVAGK 350
    ||||||||||||||||||||||||||||||||||||||||||||||||||
301 MQNKDKGLYTCRVRSGPSFKSVNTSVHIYDKAFITVKHRKQQVLETVAGK 350

351 RSYRLSMKVKAFPSPEVVWLKDGLPATEKSARYLTRGYSLIIKDVTEEDA 400
    ||||||||||||||||||||||||||||||||||||||||||||||||||
351 RSYRLSMKVKAFPSPEVVWLKDGLPATEKSARYLTRGYSLIIKDVTEEDA 400

401 GNYTILLSIKQSNVFKNLTATLIVNVKPQIYEKAVSSFPDPALYPLGSRQ 450
    ||||||||||||||||||||||||||||||||||||||||||||||||||
401 GNYTILLSIKQSNVFKNLTATLIVNVKPQIYEKAVSSFPDPALYPLGSRQ 450

451 ILTCTAYGIPQPTIKWFWHPCNHNHSEARCDFCSNNEESFILDADSNMGN 500
    ||||||||||||||||||||||||||||||||||||||||||||||||||
451 ILTCTAYGIPQPTIKWFWHPCNHNHSEARCDFCSNNEESFILDADSNMGN 500
```

```
501 RIESITQRMAIIEGKNKMASTLVVADSRISGIYICIASNKVGTVGRNISF 550
    ||||||||||||||||||||||||||||||||||||||||||||||||||
501 RIESITQRMAIIEGKNKMASTLVVADSRISGIYICIASNKVGTVGRNISF 550

551 YITDVPNGFHVNLEKMPTEGEDLKLSCTVNKFLYRDVTWILLRTVNNRTM 600
    ||||||||||||||||||||||||||||||||||||||||||||||||||
551 YITDVPNGFHVNLEKMPTEGEDLKLSCTVNKFLYRDVTWILLRTVNNRTM 600

601 HYSISKQKMAITKEHSITLNLTIMNVSLQDSGTYACRARNVYTGEEILQK 650
    ||||||||||||||||||||||||||||||||||||||||||||||||||
601 HYSISKQKMAITKEHSITLNLTIMNVSLQDSGTYACRARNVYTGEEILQK 650

651 KEITIRDQEAPYLLRNLSDHTVAISSSTTLDCHANGVPEPQITWFKNNHK 700
    ||||||||||||||||||||||||||||||||||||||||||||||||||
651 KEITIRDQEAPYLLRNLSDHTVAISSSTTLDCHANGVPEPQITWFKNNHK 700

701 IQQEPG                                            706
    ||||||
701 IQQEPG                                            706
```

Figure 159

Alignment of: HSFLT_PEA_1_P14 (SEQ ID NO:536) x VGR1_HUMAN (SEQ ID NO:530)

```
  1 MVSYWDTGVLLCALLSCLLLTGSSSGSKLKDPELSLKGTQHIMQAGQTLH  50
    ||||||||||||||||||||||||||||||||||||||||||||||||||
  1 MVSYWDTGVLLCALLSCLLLTGSSSGSKLKDPELSLKGTQHIMQAGQTLH  50

51 LQCRGEAAHKWSLPEMVSKESERLSITKSACGRNGKQFCSTLTLNTAQAN 100
    ||||||||||||||||||||||||||||||||||||||||||||||||||
 51 LQCRGEAAHKWSLPEMVSKESERLSITKSACGRNGKQFCSTLTLNTAQAN 100

101 HTGFYSCKYLAVPTSKKKETESAIYIFISDTGRPFVEMYSEIPEIIHMTE 150
    ||||||||||||||||||||||||||||||||||||||||||||||||||
101 HTGFYSCKYLAVPTSKKKETESAIYIFISDTGRPFVEMYSEIPEIIHMTE 150

151 GRELVIPCRVTSPNITVTLKKFPLDTLIPDGKRIIWDSRKGFIISNATYK 200
    ||||||||||||||||||||||||||||||||||||||||||||||||||
151 GRELVIPCRVTSPNITVTLKKFPLDTLIPDGKRIIWDSRKGFIISNATYK 200

201 EIGLLTCEATVNGHLYKTNYLTHRQTNTIIDVQISTPRPVKLLRGHTLVL 250
    ||||||||||||||||||||||||||||||||||||||||||||||||||
201 EIGLLTCEATVNGHLYKTNYLTHRQTNTIIDVQISTPRPVKLLRGHTLVL 250

251 NCTATTPLNTRVQMTWSYPDEKNKRASVRRRIDQSNSHANIFYSVLTIDK 300
    ||||||||||||||||||||||||||||||||||||||||||||||||||
251 NCTATTPLNTRVQMTWSYPDEKNKRASVRRRIDQSNSHANIFYSVLTIDK 300

301 MQNKDKGLYTCRVRSGPSFKSVNTSVHIYDKAFITVKHRKQQVLETVAGK 350
    ||||||||||||||||||||||||||||||||||||||||||||||||||
301 MQNKDKGLYTCRVRSGPSFKSVNTSVHIYDKAFITVKHRKQQVLETVAGK 350

351 RSYRLSMKVKAFPSPEVVWLKDGLPATEKSARYLTRGYSLIIKDVTEEDA 400
    ||||||||||||||||||||||||||||||||||||||||||||||||||
351 RSYRLSMKVKAFPSPEVVWLKDGLPATEKSARYLTRGYSLIIKDVTEEDA 400

401 GNYTILLSIKQSNVFKNLTATLIVNVKPQIYEKAVSSFPDPALYPLGSRQ 450
    ||||||||||||||||||||||||||||||||||||||||||||||||||
401 GNYTILLSIKQSNVFKNLTATLIVNVKPQIYEKAVSSFPDPALYPLGSRQ 450

451 ILTCTAYGIPQPTIKWFWHPCNHNHSEARCDFCSNNEESFILDADSNMGN 500
    ||||||||||||||||||||||||||||||||||||||||||||||||||
451 ILTCTAYGIPQPTIKWFWHPCNHNHSEARCDFCSNNEESFILDADSNMGN 500

501 RIESITQRMAIIEGKNK                                 517
    |||||||||||||||||
501 RIESITQRMAIIEGKNK                                 517
```

Figure 160

Alignment of: HSFLT_PEA_1_P19 (SEQ ID NO:537) x VGR1_HUMAN (SEQ ID NO:530)

```
  1 MVSYWDTGVLLCALLSCLLLTGSSSGSKLKDPELSLKGTQHIMQAGQTLH  50
    |||||||||||||||||||||||||||||||||||||||||||||||||
  1 MVSYWDTGVLLCALLSCLLLTGSSSGSKLKDPELSLKGTQHIMQAGQTLH  50

51 LQCRGEAAHKWSLPEMVSKESERLSITKSACGRNGKQFCSTLTLNTAQAN 100
    |||||||||||||||||||||||||||||||||||||||||||||||||
 51 LQCRGEAAHKWSLPEMVSKESERLSITKSACGRNGKQFCSTLTLNTAQAN 100

101 HTGFYSCKYLAVPTSKKKETESAIYIFISDTGRPFVEMYSEIPEIIHMTE 150
    |||||||||||||||||||||||||||||||||||||||||||||||||
101 HTGFYSCKYLAVPTSKKKETESAIYIFISDTGRPFVEMYSEIPEIIHMTE 150

151 GRELVIPCRVTSPNITVTLKKFPLDTLIPDGKRIIWDSRKGFIISNATYK 200
    |||||||||||||||||||||||||||||||||||||||||||||||||
151 GRELVIPCRVTSPNITVTLKKFPLDTLIPDGKRIIWDSRKGFIISNATYK 200

201 EIGLLTCEATVNGHLYKTNYLTHRQTNTIIDVQISTPRPVKLLRGHTLVL 250
    |||||||||||||||||||||||||||||||||||||||||||||||||
201 EIGLLTCEATVNGHLYKTNYLTHRQTNTIIDVQISTPRPVKLLRGHTLVL 250

251 NCTATTPLNTRVQMTWSYPDEKNKRASVRRRIDQSNSHANIFYSVLTIDK 300
    |||||||||||||||||||||||||||||||||||||||||||||||||
251 NCTATTPLNTRVQMTWSYPDEKNKRASVRRRIDQSNSHANIFYSVLTIDK 300

301 MQNKDKGLYTCRVRSGPSFKSVNTSVHIYGK                    331
    ||||||||||||||||||||||||||||| |
301 MQNKDKGLYTCRVRSGPSFKSVNTSVHIYDK                    331
```

Alignment of: HUMKDRZ_P8 (SEQ ID NO:556) x VGR2_HUMAN (SEQ ID NO:555)

```
  1 MQSKVLLAVALWLCVETRAASVGLPSVSLDLPRLSIQKDILTIKANTTLQ  50
    ||||||||||||||||||||||||||||||||||||||||||||||||||
  1 MQSKVLLAVALWLCVETRAASVGLPSVSLDLPRLSIQKDILTIKANTTLQ  50

51 ITCRGQRDLDWLWPNNQSGSEQRVEVTECSDGLFCKTLTIPKVIGNDTGA 100
    ||||||||||||||||||||||||||||||||||||||||||||||||||
 51 ITCRGQRDLDWLWPNNQSGSEQRVEVTECSDGLFCKTLTIPKVIGNDTGA 100

101 YKCFYRETDLASVIYVYVQDYRSPFIASVSDQHGVVYITENKNKTVVIPC 150
    ||||||||||||||||||||||||||||||||||||||||||||||||||
101 YKCFYRETDLASVIYVYVQDYRSPFIASVSDQHGVVYITENKNKTVVIPC 150

151 LGSISNLNVSLCARYPEKRFVPDGNRISWDSKKGFTIPSYMISYAGMVFC 200
    ||||||||||||||||||||||||||||||||||||||||||||||||||
151 LGSISNLNVSLCARYPEKRFVPDGNRISWDSKKGFTIPSYMISYAGMVFC 200

201 EAKINDESYQSIMYIVVVVGYRIYDVVLSPSHGIELSVGEKLVLNCTART 250
    ||||||||||||||||||||||||||||||||||||||||||||||||||
201 EAKINDESYQSIMYIVVVVGYRIYDVVLSPSHGIELSVGEKLVLNCTART 250

251 ELNVGIDFNWEYPSSKHQHKKLVNRDLKTQSGSEMKKFLSTLTIDGVTRS 300
    ||||||||||||||||||||||||||||||||||||||||||||||||||
251 ELNVGIDFNWEYPSSKHQHKKLVNRDLKTQSGSEMKKFLSTLTIDGVTRS 300

301 DQGLYTCAASSGLMTKKNSTFVRVHEKPFVAFGSGMESLVEATVGERVRI 350
    ||||||||||||||||||||||||||||||||||||||||||||||||||
301 DQGLYTCAASSGLMTKKNSTFVRVHEKPFVAFGSGMESLVEATVGERVRI 350

351 PAKYLGYPPPEIKWYKNGIPLESNHTIKAGHVLTIMEVSERDTGNYTVIL 400
    ||||||||||||||||||||||||||||||||||||||||||||||||||
351 PAKYLGYPPPEIKWYKNGIPLESNHTIKAGHVLTIMEVSERDTGNYTVIL 400

401 TNPISKEKQSHVVSLVVYVPPQIGEKSLISPVDSYQYGTTQTLTCTVYAI 450
    ||||||||||||||||||||||||||||||||||||||||||||||||||
401 TNPISKEKQSHVVSLVVYVPPQIGEKSLISPVDSYQYGTTQTLTCTVYAI 450

451 PPPHHIHWYWQLEEECANEPSQAVSVTNPYPCEEWRSVEDFQGGNKIEVN 500
    ||||||||||||||||||||||||||||||||||||||||||||||||||
451 PPPHHIHWYWQLEEECANEPSQAVSVTNPYPCEEWRSVEDFQGGNKIEVN 500

501 KNQFALIEGKNKTVSTLVIQAANVSALYKCEAVNKVGRGERVISFHVTRG 550
    ||||||||||||||||||||||||||||||||||||||||||||||||||
501 KNQFALIEGKNKTVSTLVIQAANVSALYKCEAVNKVGRGERVISFHVTRG 550
```

```
551 PEITLQPDMQPTEQESVSLWCTADRSTFENLTWYKLGPQPLPIHVGELPT 600
    |||||||||||||||||||||||||||||||||||||||||||||||||
551 PEITLQPDMQPTEQESVSLWCTADRSTFENLTWYKLGPQPLPIHVGELPT 600

601 PVCKNLDTLWKLNATMFSNSTNDILIMELKNASLQDQGDYVCLAQDRKTK 650
    |||||||||||||||||||||||||||||||||||||||||||||||||
601 PVCKNLDTLWKLNATMFSNSTNDILIMELKNASLQDQGDYVCLAQDRKTK 650

651 KRHCVVRQLTVL                                       662
    ||||||||||||
651 KRHCVVRQLTVL                                       662
```

Figure 162

Alignment of: HUMKDRZ_P9 (SEQ ID NO:557) x VGR2_HUMAN (SEQ ID NO:555) ..

Alignment segment 1/1:

```
  1 MQSKVLLAVALWLCVETRAASVGLPSVSLDLPRLSIQKDILTIKANTTLQ  50
    ||||||||||||||||||||||||||||||||||||||||||||||||||
  1 MQSKVLLAVALWLCVETRAASVGLPSVSLDLPRLSIQKDILTIKANTTLQ  50

51 ITCRGQRDLDWLWPNNQSGSEQRVEVTECSDGLFCKTLTIPKVIGNDTGA 100
    ||||||||||||||||||||||||||||||||||||||||||||||||||
 51 ITCRGQRDLDWLWPNNQSGSEQRVEVTECSDGLFCKTLTIPKVIGNDTGA 100

101 YKCFYRETDLASVIYVYVQDYRSPFIASVSDQHGVVYITENKNKTVVIPC 150
    ||||||||||||||||||||||||||||||||||||||||||||||||||
101 YKCFYRETDLASVIYVYVQDYRSPFIASVSDQHGVVYITENKNKTVVIPC 150

151 LGSISNLNVSLCARYPEKRFVPDGNRISWDSKKGFTIPSYMISYAGMVFC 200
    ||||||||||||||||||||||||||||||||||||||||||||||||||
151 LGSISNLNVSLCARYPEKRFVPDGNRISWDSKKGFTIPSYMISYAGMVFC 200

201 EAKINDESYQSIMYIVVVVGYRIYDVVLSPSHGIELSVGEKLVLNCTART 250
    ||||||||||||||||||||||||||||||||||||||||||||||||||
201 EAKINDESYQSIMYIVVVVGYRIYDVVLSPSHGIELSVGEKLVLNCTART 250

251 ELNVGIDFNWEYPSSKHQHKKLVNRDLKTQSGSEMKKFLSTLTIDGVTRS 300
    ||||||||||||||||||||||||||||||||||||||||||||||||||
251 ELNVGIDFNWEYPSSKHQHKKLVNRDLKTQSGSEMKKFLSTLTIDGVTRS 300

301 DQGLYTCAASSGLMTKKNSTFVRVHEKPFVAFGSGMESLVEATVGERVRI 350
    ||||||||||||||||||||||||||||||||||||||||||||||||||
301 DQGLYTCAASSGLMTKKNSTFVRVHEKPFVAFGSGMESLVEATVGERVRI 350

351 PAKYLGYPPPEIKWYKNGIPLESNHTIKAGHVLTIMEVSERDTGNYTVIL 400
    ||||||||||||||||||||||||||||||||||||||||||||||||||
351 PAKYLGYPPPEIKWYKNGIPLESNHTIKAGHVLTIMEVSERDTGNYTVIL 400

401 TNPISKEKQSHVVSLVVY                                 418
    ||||||||||||||||||
401 TNPISKEKQSHVVSLVVY                                 418
```

Figure 163

Alignment of: HUMCTLA4B_PEA_1_P3 (SEQ ID NO:565) x CTL4_HUMAN
(SEQ ID NO:564)  ..

```
  1 MACLGFQRHKAQLNLATRTWPCTLLFFLLFIPVFCKAMHVAQPAVVLASS  50
    |||||||||||||||||||||||||||||||||||||||||||||||||
  1 MACLGFQRHKAQLNLATRTWPCTLLFFLLFIPVFCKAMHVAQPAVVLASS  50

51 RGIASFVCEYASPGKATEVRVTVLRQADSQVTEVCAATYMMGNELTFLDD 100
    |||||||||||||||||||||||||||||||||||||||||||||||||
 51 RGIASFVCEYASPGKATEVRVTVLRQADSQVTEVCAATYMMGNELTFLDD 100

101 SICTGTSSGNQVNLTIQGLRAMDTGLYICKVELMYPPPYYLGIGNGTQIY 150
    |||||||||||||||||||||||||||||||||||||||||||||||||
101 SICTGTSSGNQVNLTIQGLRAMDTGLYICKVELMYPPPYYLGIGNGTQIY 150

Alignment of: HSTNFR1A_PEA_1_P11 (SEQ ID NO:632) x TR1A_HUMAN
(SEQ ID NO:631)  ..

```
  1 MGLSTVPDLLLPLVLLELLVGIYPSGVIGLVPHLGDREKRDSVCPQGKYI  50
    |||||||||||||||||||||||||||||||||||||||||||||||||
  1 MGLSTVPDLLLPLVLLELLVGIYPSGVIGLVPHLGDREKRDSVCPQGKYI  50

51 HPQNNSICCTKCHKGTYLYNDCPGPGQDTDCRECESGSFTASENHLRHCL 100
    |||||||||||||||||||||||||||||||||||||||||||||||||
 51 HPQNNSICCTKCHKGTYLYNDCPGPGQDTDCRECESGSFTASENHLRHCL 100

101 SCSKCRKEMGQVEISSCTVDRDTVCGCRKNQYRHYWSENLFQCFNCSLCL 150
    |||||||||||||||||||||||||||||||||||||||||||||||||
101 SCSKCRKEMGQVEISSCTVDRDTVCGCRKNQYRHYWSENLFQCFNCSLCL 150

151 NGTVHLSCERSSPEAKPSPHPRGWPLPHAVALPFLPPPVFCGSDNQLLSG 200
    ||||||||
151 NGTVHLSC.........................................  158

201 RPHPVPRHFLCPVGWGCRRFSFSCAALLPTGQEKQNTVCTCHAGFFLREN 250
                                  |||||||||||||||||||||
159 ...........................QEKQNTVCTCHAGFFLREN    177

251 ECVSCS                                             256
    ||||||
178 ECVSCS                                             183
```

Figure 165

Alignment of: HSTNFR1A_PEA_1_P15 (SEQ ID NO:633) x TR1A_HUMAN (SEQ ID NO:631)

```
  1 MGLSTVPDLLLPLVLLELLVGIYPSGVIGLVPHLGDREKRDSVCPQGKYI  50
    ||||||||||||||||||||||||||||||||||||||||||||||||||
  1 MGLSTVPDLLLPLVLLELLVGIYPSGVIGLVPHLGDREKRDSVCPQGKYI  50

51 HPQNNSICCTKCHKGTYLYNDCPGPGQDTDCRECESGSFTASENHLRHCL 100
    ||||||||||||||||||||||||||||||||||||||||||||||||||
 51 HPQNNSICCTKCHKGTYLYNDCPGPGQDTDCRECESGSFTASENHLRHCL 100

101 SCSKCRKEMGQVEISSCTVDRDTVCGCRKNQYRHYWSENLFQCFNCSLCL 150
    ||||||||||||||||||||||||||||||||||||||||||||||||||
101 SCSKCRKEMGQVEISSCTVDRDTVCGCRKNQYRHYWSENLFQCFNCSLCL 150

151 NGTVHLSCQEKQNTVCTCHAGFFLRENECVSCS                 183
    |||||||||||||||||||||||||||||||||
151 NGTVHLSCQEKQNTVCTCHAGFFLRENECVSCS                 183
```

Figure 166

Alignment of: HSTNFR1A_PEA_1_P19 (SEQ ID NO:634) x TR1A_HUMAN (SEQ ID NO:631) ..

```
  1 MGLSTVPDLLLPLVLLELLVGIYPSGVIGLVPHLGDREKRDSVCPQGKYI  50
    ||||||||||||||||||||||||||||||||||||||||||||||||||
  1 MGLSTVPDLLLPLVLLELLVGIYPSGVIGLVPHLGDREKRDSVCPQGKYI  50

51 HPQNNSICCTKCHKGTYLYNDCPGPGQDTDCRECESGSFTASENHLRHCL 100
    ||||||||||||||||||||||||||||||||||||||||||||||||||
 51 HPQNNSICCTKCHKGTYLYNDCPGPGQDTDCRECESGSFTASENHLRHCL 100

101 SCSKCRKEMGQVEISSCTVDRDTVCGCRKNQYRHYWSENLFQCFNCSLCL 150
    ||||||||||||||||||||||||||||||||||||||||||||||||||
101 SCSKCRKEMGQVEISSCTVDRDTVCGCRKNQYRHYWSENLFQCFNCSLCL 150

151 NGTVHLSCQEKQNTVCTCHAGFFLRENECVSCSNCKKSLECTKLCLPQIE 200
    ||||||||||||||||||||||||||||||||||||||||||||||||||
151 NGTVHLSCQEKQNTVCTCHAGFFLRENECVSCSNCKKSLECTKLCLPQIE 200

201 NVKGTEDSGTTVLL.................................... 214
    ||||||||||||||
201 NVKGTEDSGTTVLLPLVIFFGLCLLSLLFIGLMYRYQRWKSKLYSIVCGK 250

215 ................PLAPNPSFSPTPGFTPTLGFSPVPSSTFTSSSTYT 249
                    |||||||||||||||||||||||||||||||||||
251 STPEKEGELEGTTTKPLAPNPSFSPTPGFTPTLGFSPVPSSTFTSSSTYT 300

250 PGDCPNFAAPRREVAPPYQGADPILATALASDPIPNPLQKWEDSAHKPQS 299
    ||||||||||||||||||||||||||||||||||||||||||||||||||
301 PGDCPNFAAPRREVAPPYQGADPILATALASDPIPNPLQKWEDSAHKPQS 350

300 LDTDDPATLYAVVENVPPLRWKEFVRRLGLSDHEIDRLELQNGRCLREAQ 349
    ||||||||||||||||||||||||||||||||||||||||||||||||||
351 LDTDDPATLYAVVENVPPLRWKEFVRRLGLSDHEIDRLELQNGRCLREAQ 400

350 YSMLATWRRRTPRREATLELLGRVLRDMDLLGCLEDIEEALCGPAALPPA 399
    ||||||||||||||||||||||||||||||||||||||||||||||||||
401 YSMLATWRRRTPRREATLELLGRVLRDMDLLGCLEDIEEALCGPAALPPA 450

400 PSLLR                                             404
    |||||
451 PSLLR                                             455
```

Figure 167

Alignment of: HSTNFR1A_PEA_1_P20 (SEQ ID NO:635) x TR1A_HUMAN (SEQ ID NO:631) ..

```
  1 MGLSTVPDLLLPLVLLELLVGIYPSGVIGLVPHLGDREKRDSVCPQGKYI  50
    |||||||||||||||||||||||||||||||||||||||||||||||||
  1 MGLSTVPDLLLPLVLLELLVGIYPSGVIGLVPHLGDREKRDSVCPQGKYI  50

51 HPQNNSICCTKCHKGTYLYNDCPGPGQDTDCRECESGSFTASENHLRHCL 100
    |||||||||||||||||||||||||||||||||||||||||||||||||
 51 HPQNNSICCTKCHKGTYLYNDCPGPGQDTDCRECESGSFTASENHLRHCL 100

101 SCSKCRKEMGQVEISSCTVDRDTVCGCRKNQYRHYWSENLFQCFNCSLCL 150
    |||||||||||||||||||||||||||||||||||||||||||||||||
101 SCSKCRKEMGQVEISSCTVDRDTVCGCRKNQYRHYWSENLFQCFNCSLCL 150

151 NGTVHLSCQEKQNTVCTCHAGFFLRENECVSCS                 183
    |||||||||||||||||||||||||||||||||
151 NGTVHLSCQEKQNTVCTCHAGFFLRENECVSCS                 183
```

Figure 168

Alignment of: HSTNFR1A_PEA_1_P22 (SEQ ID NO:636) x TR1A_HUMAN (SEQ ID NO:631) ..

```
  1 MGLSTVPDLLLPLVLLELLVGIYPSGVIGLVPHLGDREKRDSVCPQGKYI  50
    |||||||||||||||||||||||||||||||||||||||||||||||||
  1 MGLSTVPDLLLPLVLLELLVGIYPSGVIGLVPHLGDREKRDSVCPQGKYI  50

51 HPQNNSICCTKCHKGTYLYNDCPGPGQDTDCRECESGSFTASENHLRHCL 100
    |||||||||||||||||||||||||||||||||||||||||||||||||
 51 HPQNNSICCTKCHKGTYLYNDCPGPGQDTDCRECESGSFTASENHLRHCL 100

101 SCSKCRKEMGQVEISSCTVDRDTVCGCRKNQYRHYWSENLFQCFNCSLCL 150
    |||||||||||||||||||||||||||||||||||||||||||||||||
101 SCSKCRKEMGQVEISSCTVDRDTVCGCRKNQYRHYWSENLFQCFNCSLCL 150

151 NGTVHLSCQEKQNTVCTCHAGFFLRENECVSCSNCKKSLECTKLCLPQIE 200
    |||||||||||||||||||||||||||||||||||||||||||||||||
151 NGTVHLSCQEKQNTVCTCHAGFFLRENECVSCSNCKKSLECTKLCLPQIE 200

201 NVKGTEDS                                          208
    ||||||||
201 NVKGTEDS                                          208
```

Figure 169

Alignment of: HSTNFR1A_PEA_1_P23 (SEQ ID NO:637) x TR1A_HUMAN (SEQ ID NO:631)

```
  1 MGLSTVPDLLLPLVLLELLVGIYPSGVIGLVPHLGDREKRDSVCPQGKYI  50
    ||||||||||||||||||||||||||||||||||||||||||||||||||
  1 MGLSTVPDLLLPLVLLELLVGIYPSGVIGLVPHLGDREKRDSVCPQGKYI  50

51 HPQNNSICCTKCHKGTYLYNDCPGPGQDTDCRECESGSFTASENHLRHCL 100
    ||||||||||||||||||||||||||||||||||||||||||||||||||
 51 HPQNNSICCTKCHKGTYLYNDCPGPGQDTDCRECESGSFTASENHLRHCL 100

101 SCSKCRKEMGQVEISSCTVDRDTVCGCRKNQYRHYWSENLFQCFNCSLCL 150
    ||||||||||||||||||||||||||||||||||||||||||||||||||
101 SCSKCRKEMGQVEISSCTVDRDTVCGCRKNQYRHYWSENLFQCFNCSLCL 150

151 NGTVHLSCQEKQNTVCTCHAGFFLRENECVSCS                 183
    |||||||||||||||||||||||||||||||||
151 NGTVHLSCQEKQNTVCTCHAGFFLRENECVSCS                 183
```

Figure 170

Alignment of: HSTNFR1A_PEA_1_P24 (SEQ ID NO:638) x TR1A_HUMAN (SEQ ID NO:631)

```
  1 MGLSTVPDLLLPLVLLELLVGIYPSGVIGLVPHLGDREKRDSVCPQGKYI  50
    ||||||||||||||||||||||||||||||||||||||||||||||||||
  1 MGLSTVPDLLLPLVLLELLVGIYPSGVIGLVPHLGDREKRDSVCPQGKYI  50

51 HPQNNSICCTKCHKGTYLYNDCPGPGQDTDCRECESGSFTASENHLRHCL 100
    ||||||||||||||||||||||||||||||||||||||||||||||||||
 51 HPQNNSICCTKCHKGTYLYNDCPGPGQDTDCRECESGSFTASENHLRHCL 100

101 SCSKCRKEMGQVEISSCTVDRDTVCGCRKNQYRHYWSENLFQCFNCSLCL 150
    ||||||||||||||||||||||||||||||||||||||||||||||||||
101 SCSKCRKEMGQVEISSCTVDRDTVCGCRKNQYRHYWSENLFQCFNCSLCL 150

151 NGTVHLSCQEKQNTVCTCHAGFFLRENECVSCSNCKKSLECTKLCLPQIE 200
    ||||||||||||||||||||||||||||||||||||||||||||||||||
151 NGTVHLSCQEKQNTVCTCHAGFFLRENECVSCSNCKKSLECTKLCLPQIE 200

201 NVKGTEDSGTTVLLPLV                                  217
    |||||||||||||||||
201 NVKGTEDSGTTVLLPLV                                  217
```

Figure 171

Alignment of: HSTNFR1A_PEA_1_P28 (SEQ ID NO:639) x TR1A_HUMAN (SEQ ID NO:631)

```
  1 MGLSTVPDLLLPLVLLELLVGIYPSGVIGLVPHLGDREKRDSVCPQGKYI  50
    ||||||||||||||||||||||||||||||||||||||||||||||||||
  1 MGLSTVPDLLLPLVLLELLVGIYPSGVIGLVPHLGDREKRDSVCPQGKYI  50

51 HPQNNSICCTKCHKGTYLYNDCPGPGQDTDCRECESGSFTASENHLRHCL 100
    ||||||||||||||||||||||||||||||||||||||||||||||||||
 51 HPQNNSICCTKCHKGTYLYNDCPGPGQDTDCRECESGSFTASENHLRHCL 100

101 SCSKCRKEMGQVEISSCTVDRDTVCGCRKNQYRHYWSENLFQCFNCSLCL 150
    ||||||||||||||||||||||||||||||||||||||||||||||||||
101 SCSKCRKEMGQVEISSCTVDRDTVCGCRKNQYRHYWSENLFQCFNCSLCL 150

151 NGTVHLSCQEKQNTVCTCHAGFFLRENECVSCS                  183
    |||||||||||||||||||||||||||||||||
151 NGTVHLSCQEKQNTVCTCHAGFFLRENECVSCS                  183
```

Alignment of: HUMC5_PEA_3_P12 (SEQ ID NO:727 x CO5_HUMAN_V1 (SEQ ID NO:730)

```
  1 MGLLGILCFLIFLGKTWGQEQTYVISAPKIFRVGASENIVIQVYGYTEAF  50
    ||||||||||||||||||||||||||||||||||||||||||||||||||
  1 MGLLGILCFLIFLGKTWGQEQTYVISAPKIFRVGASENIVIQVYGYTEAF  50

51 DATISIKSYPDKKFSYSSGHVHLSSENKFQNSAILTIQPKQLPGGQNPVS 100
    ||||||||||||||||||||||||||||||||||||||||||||||||||
 51 DATISIKSYPDKKFSYSSGHVHLSSENKFQNSAILTIQPKQLPGGQNPVS 100

101 YVYLEVVSKHFSKSKRMPITYDNGFLFIHTDKPVYTPDQSVKVRVYSLND 150
    ||||||||||||||||||||||||||||||||||||||||||||||||||
101 YVYLEVVSKHFSKSKRMPITYDNGFLFIHTDKPVYTPDQSVKVRVYSLND 150

151 DLKPAKRETVLTFIDPEGSEVDMVEEIDHIGIISFPDFKIPSNPRYGMWT 200
    ||||||||||||||||||||||||||||||||||||||||||||||||||
151 DLKPAKRETVLTFIDPEGSEVDMVEEIDHIGIISFPDFKIPSNPRYGMWT 200

201 IKAKYKEDFSTTGTAYFEVKEYVLPHFSVSIEPEYNFIGYKNFKNFEITI 250
    ||||||||||||||||||||||||||||||||||||||||||||||||||
201 IKAKYKEDFSTTGTAYFEVKEYVLPHFSVSIEPEYNFIGYKNFKNFEITI 250

251 KARYFYNKVVTEADVYITFGIREDLKDDQKEMMQTAMQNTMLINGIAQVT 300
    ||||||||||||||||||||||||||||||||||||||||||||||||||
251 KARYFYNKVVTEADVYITFGIREDLKDDQKEMMQTAMQNTMLINGIAQVT 300

301 FDSETAVKELSYYSLEDLNNKYLYIAVTVIESTGGFSEEAEIPGIKYVLS 350
    ||||||||||||||||||||||||||||||||||||||||||||||||||
301 FDSETAVKELSYYSLEDLNNKYLYIAVTVIESTGGFSEEAEIPGIKYVLS 350

351 PYKLNLVATPLFLKPGIPYPIKVQVKDSLDQLVGGVPVTLNAQTIDVNQE 400
    |||||||||||||||||||||||||||||||||||| |||||||||||
351 PYKLNLVATPLFLKPGIPYPIKVQVKDSLDQLVGGVPVILNAQTIDVNQE 400

401 TSDLDPSKSVTRVDDGVASFVLNLPSGVTVLEFNVKTDAPDLPEENQARE 450
    ||||||||||||||||||||||||||||||||||||||||||||||||||
401 TSDLDPSKSVTRVDDGVASFVLNLPSGVTVLEFNVKTDAPDLPEENQARE 450
```

```
451 GYRAIAYSSLSQSYLYIDWTDNHKALLVGEHLNIIVTPKSPYIDKITHYN 500
    ||||||||||||||||||||||||||||||||||||||||||||||||||
451 GYRAIAYSSLSQSYLYIDWTDNHKALLVGEHLNIIVTPKSPYIDKITHYN 500

501 YLILSKGKIIHFGTREKFSDASYQSINIPVTQNMVPSSRLLVYYIVTGEQ 550
    ||||||||||||||||||||||||||||||||||||||||||||||||||
501 YLILSKGKIIHFGTREKFSDASYQSINIPVTQNMVPSSRLLVYYIVTGEQ 550

551 TAELVSDSVWLNIEEKCGNQLQVHLSPDADAYSPGQTVSLNMATGMDSWV 600
    ||||||||||||||||||||||||||||||||||||||||||||||||||
551 TAELVSDSVWLNIEEKCGNQLQVHLSPDADAYSPGQTVSLNMATGMDSWV 600

601 ALAAVDSAVYGVQRGAKKPLERVFQFLEKSDLGCGAGGGLNNANVFHLAG 650
    ||||||||||||||||||||||||||||||||||||||||||||||||||
601 ALAAVDSAVYGVQRGAKKPLERVFQFLEKSDLGCGAGGGLNNANVFHLAG 650

651 LTFLTNANADDSQENDEPCKEILRPRRTLQKKIEEIAAKYKHSVVKKCCY 700
    ||||||||||||||||||||||||||||||||||||||||||||||||||
651 LTFLTNANADDSQENDEPCKEILRPRRTLQKKIEEIAAKYKHSVVKKCCY 700

701 DGACVNNDETCEQRAARISLGPRCIKAFTECCVVASQLRANISHKDMQLG 750
    ||||||||||||||||||||||||||||||||||||||||||||||||||
701 DGACVNNDETCEQRAARISLGPRCIKAFTECCVVASQLRANISHKDMQLG 750

751 RLHMKTLLPVSKPEIRSYFPESWLWEVHLVPRRKQLQFALPDSLTTWEIQ 800
    ||||||||||||||||||||||||||||||||||||||||||||||||||
751 RLHMKTLLPVSKPEIRSYFPESWLWEVHLVPRRKQLQFALPDSLTTWEIQ 800

801 GVGISNTGICVADTVKAKVFKDVFLEMNIPYSVVRGEQIQLKGTVYNYRT 850
    ||||||||||||||||||||||||||||||||||||||||||||||||||
801 GVGISNTGICVADTVKAKVFKDVFLEMNIPYSVVRGEQIQLKGTVYNYRT 850

851 SGMQ                                             854
    ||||
851 SGMQ                                             854
```

Alignment of: HUMC5_PEA_3_P13 (SEQ ID NO:728) x CO5_HUMAN (SEQ ID NO:730)

```
  1 MGLLGILCFLIFLGKTWGQEQTYVISAPKIFRVGASENIVIQVYGYTEAF  50
    ||||||||||||||||||||||||||||||||||||||||||||||||||
  1 MGLLGILCFLIFLGKTWGQEQTYVISAPKIFRVGASENIVIQVYGYTEAF  50

51 DATISIKSYPDKKFSYSSGHVHLSSENKFQNSAILTIQPKQLPGGQNPVS 100
    ||||||||||||||||||||||||||||||||||||||||||||||||||
 51 DATISIKSYPDKKFSYSSGHVHLSSENKFQNSAILTIQPKQLPGGQNPVS 100

101 YVYLEVVSKHFSKSKRMPITYDNGFLFIHTDKPVYTPDQSVKVRVYSLND 150
    ||||||||||||||||||||||||||||||||||||||||||||||||||
101 YVYLEVVSKHFSKSKRMPITYDNGFLFIHTDKPVYTPDQSVKVRVYSLND 150

151 DLKPAKRETVLTFIDPEGSEVDMVEEIDHIGIISFPDFKIPSNPRYGMWT 200
    ||||||||||||||||||||||||||||||||||||||||||||||||||
151 DLKPAKRETVLTFIDPEGSEVDMVEEIDHIGIISFPDFKIPSNPRYGMWT 200

201 IKAKYKEDFSTTGTAYFEVKEYVLPHFSVSIEPEYNFIGYKNFKNFEITI 250
    ||||||||||||||||||||||||||||||||||||||||||||||||||
201 IKAKYKEDFSTTGTAYFEVKEYVLPHFSVSIEPEYNFIGYKNFKNFEITI 250

251 KARYFYNKVVTEADVYITFGIREDLKDDQKEMMQTAMQNTMLINGIAQVT 300
    ||||||||||||||||||||||||||||||||||||||||||||||||||
251 KARYFYNKVVTEADVYITFGIREDLKDDQKEMMQTAMQNTMLINGIAQVT 300

301 FDSETAVKELSYYSLEDLNNKYLYIAVTVIESTGGFSEEAEIPGIKYVLS 350
    ||||||||||||||||||||||||||||||||||||||||||||||||||
301 FDSETAVKELSYYSLEDLNNKYLYIAVTVIESTGGFSEEAEIPGIKYVLS 350

351 PYKLNLVATPLFLKPGIPYPIKVQVKDSLDQLVGGVPVTLNAQTIDVNQE 400
    |||||||||||||||||||||||||||||||||||| |||||||||||||
351 PYKLNLVATPLFLKPGIPYPIKVQVKDSLDQLVGGVPVILNAQTIDVNQE 400

401 TSDLDPSKSVTRVDDGVASFVLNLPSGVTVLEFNVKTDAPDLPEENQARE 450
    ||||||||||||||||||||||||||||||||||||||||||||||||||
401 TSDLDPSKSVTRVDDGVASFVLNLPSGVTVLEFNVKTDAPDLPEENQARE 450
```

```
451 GYRAIAYSSLSQSYLYIDWTDNHKALLVGEHLNIIVTPKSPYIDKITHYN 500
    ||||||||||||||||||||||||||||||||||||||||||||||||||
451 GYRAIAYSSLSQSYLYIDWTDNHKALLVGEHLNIIVTPKSPYIDKITHYN 500

501 YLV                                                503
    ||:
501 YLI                                                503
```

Figure 174

Alignment of: HUMC5_PEA_3_P15 (SEQ ID NO:729) x CO5_HUMAN (SEQ ID NO:730)

```
  1 MGLLGILCFLIFLGKTWGQEQTYVISAPKIFRVGASENIVIQVYGYTEAF  50
    ||||||||||||||||||||||||||||||||||||||||||||||||||
  1 MGLLGILCFLIFLGKTWGQEQTYVISAPKIFRVGASENIVIQVYGYTEAF  50

51 DATISIKSYPDKKFSYSSGHVHLSSENKFQNSAILTIQPKQLPGGQNPVS 100
    ||||||||||||||||||||||||||||||||||||||||||||||||||
 51 DATISIKSYPDKKFSYSSGHVHLSSENKFQNSAILTIQPKQLPGGQNPVS 100

101 YVYLEVVSKHFSKSKRMPITYDNGFLFIHTDKPVYTPDQSVKVRVYSLND 150
    ||||||||||||||||||||||||||||||||||||||||||||||||||
101 YVYLEVVSKHFSKSKRMPITYDNGFLFIHTDKPVYTPDQSVKVRVYSLND 150

151 DLKPAKRETVLTFIDPEGSEVDMVEEIDHIGIISFPDFKIPSNPRYGMWT 200
    ||||||||||||||||||||||||||||||||||||||||||||||||||
151 DLKPAKRETVLTFIDPEGSEVDMVEEIDHIGIISFPDFKIPSNPRYGMWT 200

201 IKAKYKEDFSTTGTAYFEVKEYVLPHFSVSIEPEYNFIGYKNFKNFEITI 250
    ||||||||||||||||||||||||||||||||||||||||||||||||||
201 IKAKYKEDFSTTGTAYFEVKEYVLPHFSVSIEPEYNFIGYKNFKNFEITI 250

251 KARYFYNKVVTEADVYITFGIREDLKDDQKEMMQTAMQNTML         292
    |||||||||||||||||||||||||||||||||||||||||
251 KARYFYNKVVTEADVYITFGIREDLKDDQKEMMQTAMQNTML         292
```

Figure 175

Alignment of: HUMFVIII_PEA_1_P9 (SEQ ID NO:765) x FA8_HUMAN (SEQ ID NO:769) ..

```
  1 MQIELSTCFFLCLLRFCFSATRRYYLGAVELSWDYMQSDLGELPVDARFP  50
    ||||||||||||||||||||||||||||||||||||||||||||||||||
  1 MQIELSTCFFLCLLRFCFSATRRYYLGAVELSWDYMQSDLGELPVDARFP  50

51 PRVPKSFPFNTSVVYKKTLFVEFTDHLFNIAKPRPPWMGLLGPTIQAEVY 100
    ||||||||||||||||||||||||||||||||||||||||||||||||||
 51 PRVPKSFPFNTSVVYKKTLFVEFTDHLFNIAKPRPPWMGLLGPTIQAEVY 100

101 DTVVITLKNMASHPVSLHAVGVSYWKASEGAEYDDQTSQREKEDDKVFPG 150
    ||||||||||||||||||||||||||||||||||||||||||||||||||
101 DTVVITLKNMASHPVSLHAVGVSYWKASEGAEYDDQTSQREKEDDKVFPG 150

151 GSHTYVWQVLKENGPMASDPLCLTYSYLSHVDLVKDLNSGLIGALLVCRE 200
    ||||||||||||||||||||||||||||||||||||||||||||||||||
151 GSHTYVWQVLKENGPMASDPLCLTYSYLSHVDLVKDLNSGLIGALLVCRE 200

201 GSLAKEKTQTLHKFILLFAVFDEGKSWHSETKNSLMQDRDAASARAWPKM 250
    ||||||||||||||||||||||||||||||||||||||||||||||||||
201 GSLAKEKTQTLHKFILLFAVFDEGKSWHSETKNSLMQDRDAASARAWPKM 250

251 HTVNGYVNRSLPG                                     263
    |||||||||||||
251 HTVNGYVNRSLPG                                     263
```

Alignment of: HUMFVIII_PEA_1_P10 (SEQ ID NO:766) x FA8_HUMAN (SEQ ID NO:769) ..

```
    14 FPPRVPKSFPFNTSVVYKKTLFVEFTDHLFNIAKPRPPWMGLLGPTIQAE  63
       ||||||||||||||||||||||||||||||||||||||||||||||||||
    49 FPPRVPKSFPFNTSVVYKKTLFVEFTDHLFNIAKPRPPWMGLLGPTIQAE  98

64 VYDTVVITLKNMASHPVSLHAVGVSYWKASEGAEYDDQTSQREKEDDKVF 113
       ||||||||||||||||||||||||||||||||||||||||||||||||||
    99 VYDTVVITLKNMASHPVSLHAVGVSYWKASEGAEYDDQTSQREKEDDKVF 148

114 PGGSHTYVWQVLKENGPMASDPLCLTYSYLSHVDLVKDLNSGLIGALLVC 163
       ||||||||||||||||||||||||||||||||||||||||||||||||||
   149 PGGSHTYVWQVLKENGPMASDPLCLTYSYLSHVDLVKDLNSGLIGALLVC 198

164 REGSLAKEKTQTLHKFILLFAVFDEGKSWHSETKNSLMQDRDAASARAWP 213
       ||||||||||||||||||||||||||||||||||||||||||||||||||
   199 REGSLAKEKTQTLHKFILLFAVFDEGKSWHSETKNSLMQDRDAASARAWP 248

214 KMHTVNGYVNRSLPGLIGCHRKSVYWHVIGMGTTPEVHSIFLEGHTFLVR 263
       ||||||||||||||||||||||||||||||||||||||||||||||||||
   249 KMHTVNGYVNRSLPGLIGCHRKSVYWHVIGMGTTPEVHSIFLEGHTFLVR 298

264 NHRQASLEISPITFLTAQTLLMDLGQFLLFCHISSHQHDGMEAYVKVDSC 313
       ||||||||||||||||||||||||||||||||||||||||||||||||||
   299 NHRQASLEISPITFLTAQTLLMDLGQFLLFCHISSHQHDGMEAYVKVDSC 348

314 PEEPQLRMKNNEEAEDYDDDLTDSEMDVVRFDDDNSPSFIQIRSVAKKHP 363
       ||||||||||||||||||||||||||||||||||||||||||||||||||
   349 PEEPQLRMKNNEEAEDYDDDLTDSEMDVVRFDDDNSPSFIQIRSVAKKHP 398

364 KTWVHYIAAEEEDWDYAPLVLAPDDRSYKSQYLNNGPQRIGRKYKKVRFM 413
       ||||||||||||||||||||||||||||||||||||||||||||||||||
   399 KTWVHYIAAEEEDWDYAPLVLAPDDRSYKSQYLNNGPQRIGRKYKKVRFM 448

414 AYTDETFKTREAIQHESGILGPLLYGEVGDTLLIIFKNQASRPYNIYPHG 463
       ||||||||||||||||||||||||||||||||||||||||||||||||||
   449 AYTDETFKTREAIQHESGILGPLLYGEVGDTLLIIFKNQASRPYNIYPHG 498
```

```
464 ITDVRPLYSRRLPKGVKHLKDFPILPGEIFKYKWTVTVEDGPTKSDPRCL 513
    |||||||||||||||||||||||||||||||||||||||||||||||||
499 ITDVRPLYSRRLPKGVKHLKDFPILPGEIFKYKWTVTVEDGPTKSDPRCL 548

514 TRYYSSFVNMERDLASGLIGPLLICYKESVDQRGNQIMSDKRNVILFSVF 563
    |||||||||||||||||||||||||||||||||||||||||||||||||
549 TRYYSSFVNMERDLASGLIGPLLICYKESVDQRGNQIMSDKRNVILFSVF 598

564 DENRSWYLTENIQRFLPNPAGVQLEDPEFQASNIMHSINGYVFDSLQLSV 613
    |||||||||||||||||||||||||||||||||||||||||||||||||
599 DENRSWYLTENIQRFLPNPAGVQLEDPEFQASNIMHSINGYVFDSLQLSV 648

614 CLHEVAYWYILSIGAQTDFLSVFFSGYTFKHKMVYEDTLTLFPFSGETVF 663
    |||||||||||||||||||||||||||||||||||||||||||||||||
649 CLHEVAYWYILSIGAQTDFLSVFFSGYTFKHKMVYEDTLTLFPFSGETVF 698

664 MSMENPGLWILGCHNSDFRNRGMTALLKVSSCDKNTGDYYEDSYEDISAY 713
    |||||||||||||||||||||||||||||||||||||||||||||||||
699 MSMENPGLWILGCHNSDFRNRGMTALLKVSSCDKNTGDYYEDSYEDISAY 748

714 LLSKNNAIEPRSFSQNSRHPSTRQKQFNATTIPENDIEKTDPWFAHRTPM 763
    |||||||||||||||||||||||||||||||||||||||||||||||||
749 LLSKNNAIEPRSFSQNSRHPSTRQKQFNATTIPENDIEKTDPWFAHRTPM 798

764 PKIQNVSSSDLLMLLRQSPTPHGLSLSDLQEAKYETFSDDPSPGAIDSNN 813
    |||||||||||||||||||||||||||||||||||||||||||||||||
799 PKIQNVSSSDLLMLLRQSPTPHGLSLSDLQEAKYETFSDDPSPGAIDSNN 848

814 SLSEMTHFRPQLHHSGDMVFTPESGLQLRLNEKLGTTAATELKKLDFKVS 863
    |||||||||||||||||||||||||||||||||||||||||||||||||
849 SLSEMTHFRPQLHHSGDMVFTPESGLQLRLNEKLGTTAATELKKLDFKVS 898

864 STSNNLISTIPSDNLAAGTDNTSSLGPPSMPVHYDSQLDTTLFGKKSSPL 913
    |||||||||||||||||||||||||||||||||||||||||||||||||
899 STSNNLISTIPSDNLAAGTDNTSSLGPPSMPVHYDSQLDTTLFGKKSSPL 948

914 TESGGPLSLSEENNDSKLLESGLMNSQESSWGKNVSSTESGRLFKGKRAH 963
    |||||||||||||||||||||||||||||||||||||||||||||||||
949 TESGGPLSLSEENNDSKLLESGLMNSQESSWGKNVSSTESGRLFKGKRAH 998
```

```
 964 GPALLTKDNALFKVSISLLKTNKTSNNSATNRKTHIDGPSLLIENSPSVW 1013
     ||||||||||||||||||||||||||||||||||||||||||||||||||
 999 GPALLTKDNALFKVSISLLKTNKTSNNSATNRKTHIDGPSLLIENSPSVW 1048

1014 QNILESDTEFKKVTPLIHDRMLMDKNATALRLNHMSNKTTSSKNMEMVQQ 1063
     ||||||||||||||||||||||||||||||||||||||||||||||||||
1049 QNILESDTEFKKVTPLIHDRMLMDKNATALRLNHMSNKTTSSKNMEMVQQ 1098

1064 KKEGPIPPDAQNPDMSFFKMLFLPESARWIQRTHGKNSLNSGQGPSPKQL 1113
     ||||||||||||||||||||||||||||||||||||||||||||||||||
1099 KKEGPIPPDAQNPDMSFFKMLFLPESARWIQRTHGKNSLNSGQGPSPKQL 1148

1114 VSLGPEKSVEGQNFLSEKNKVVVGKGEFTKDVGLKEMVFPSSRNLFLTNL 1163
     ||||||||||||||||||||||||||||||||||||||||||||||||||
1149 VSLGPEKSVEGQNFLSEKNKVVVGKGEFTKDVGLKEMVFPSSRNLFLTNL 1198

1164 DNLHENNTHNQEKKIQEEIEKKETLIQENVVLPQIHTVTGTKNFMKNLFL 1213
     ||||||||||||||||||||||||||||||||||||||||||||||||||
1199 DNLHENNTHNQEKKIQEEIEKKETLIQENVVLPQIHTVTGTKNFMKNLFL 1248

1214 LSTRQNVEGSYDGAYAPVLQDFRSLNDSTNRTKKHTAHFSKKGEEENLEG 1263
     ||||||||||||||||||||||||||||||||||||||||||||||||||
1249 LSTRQNVEGSYDGAYAPVLQDFRSLNDSTNRTKKHTAHFSKKGEEENLEG 1298

1264 LGNQTKQIVEKYACTTRISPNTSQQNFVTQRSKRALKQFRLPLEETELEK 1313
     ||||||||||||||||||||||||||||||||||||||||||||||||||
1299 LGNQTKQIVEKYACTTRISPNTSQQNFVTQRSKRALKQFRLPLEETELEK 1348

1314 RIIVDDTSTQWSKNMKHLTPSTLTQIDYNEKEKGAITQSPLSDCLTRSHS 1363
     ||||||||||||||||||||||||||||||||||||||||||||||||||
1349 RIIVDDTSTQWSKNMKHLTPSTLTQIDYNEKEKGAITQSPLSDCLTRSHS 1398

1364 IPQANRSPLPIAKVSSFPSIRPIYLTRVLFQDNSSHLPAASYRKKDSGVQ 1413
     ||||||||||||||||||||||||||||||||||||||||||||||||||
1399 IPQANRSPLPIAKVSSFPSIRPIYLTRVLFQDNSSHLPAASYRKKDSGVQ 1448

1414 ESSHFLQGAKKNNLSLAILTLEMTGDQREVGSLGTSATNSVTYKKVENTV 1463
     ||||||||||||||||||||||||||||||||||||||||||||||||||
1449 ESSHFLQGAKKNNLSLAILTLEMTGDQREVGSLGTSATNSVTYKKVENTV 1498
```

```
1464 LPKPDLPKTSGKVELLPKVHIYQKDLFPTETSNGSPGHLDLVEGSLLQGT 1513
     ||||||||||||||||||||||||||||||||||||||||||||||||||
1499 LPKPDLPKTSGKVELLPKVHIYQKDLFPTETSNGSPGHLDLVEGSLLQGT 1548

1514 EGAIKWNEANRPGKVPFLRVATESSAKTPSKLLDPLAWDNHYGTQIPKEE 1563
     ||||||||||||||||||||||||||||||||||||||||||||||||||
1549 EGAIKWNEANRPGKVPFLRVATESSAKTPSKLLDPLAWDNHYGTQIPKEE 1598

1564 WKSQEKSPEKTAFKKKDTILSLNACESNHAIAAINEGQNKPEIEVTWAKQ 1613
     ||||||||||||||||||||||||||||||||||||||||||||||||||
1599 WKSQEKSPEKTAFKKKDTILSLNACESNHAIAAINEGQNKPEIEVTWAKQ 1648

1614 GRTERLCSQNPPVLKRHQREITRTTLQSDQEEIDYDDTISVEMKKEDFDI 1663
     ||||||||||||||||||||||||||||||||||||||||||||||||||
1649 GRTERLCSQNPPVLKRHQREITRTTLQSDQEEIDYDDTISVEMKKEDFDI 1698

1664 YDEDENQSPRSFQKKTRHYFIAAVERLWDYGMSSSPHVLRNRAQSGSVPQ 1713
     ||||||||||||||||||||||||||||||||||||||||||||||||||
1699 YDEDENQSPRSFQKKTRHYFIAAVERLWDYGMSSSPHVLRNRAQSGSVPQ 1748

1714 FKKVVFQEFTDGSFTQPLYRGELNEHLGLLGPYIRAEVEDNIMVTFRNQA 1763
     ||||||||||||||||||||||||||||||||||||||||||||||||||
1749 FKKVVFQEFTDGSFTQPLYRGELNEHLGLLGPYIRAEVEDNIMVTFRNQA 1798

1764 SRPYSFYSSLISYEEDQRQGAEPRKNFVKPNETKTYFWKVQHHMAPTKDE 1813
     ||||||||||||||||||||||||||||||||||||||||||||||||||
1799 SRPYSFYSSLISYEEDQRQGAEPRKNFVKPNETKTYFWKVQHHMAPTKDE 1848

1814 FDCKAWAYFSDVDLEKDVHSGLIGPLLVCHTNTLNPAHGRQVTVQEFALF 1863
     ||||||||||||||||||||||||||||||||||||||||||||||||||
1849 FDCKAWAYFSDVDLEKDVHSGLIGPLLVCHTNTLNPAHGRQVTVQEFALF 1898

1864 FTIFDETKSWYFTENMERNCRAPCNIQMEDPTFKENYRFHAINGYIMDTL 1913
     ||||||||||||||||||||||||||||||||||||||||||||||||||
1899 FTIFDETKSWYFTENMERNCRAPCNIQMEDPTFKENYRFHAINGYIMDTL 1948

1914 PGLVMAQDQRIRWYLLSMGSNENIHSIHFSGHVFTVRKKEEYKMALYNLY 1963
     ||||||||||||||||||||||||||||||||||||||||||||||||||
1949 PGLVMAQDQRIRWYLLSMGSNENIHSIHFSGHVFTVRKKEEYKMALYNLY 1998
```

```
1964 PGVFETVEMLPSKAGIWRVECLIGEHLHAGMSTLFLVYSNKCQTPLGMAS 2013
     |||||||||||||||||||||||||||||||||||||||||||||||||
1999 PGVFETVEMLPSKAGIWRVECLIGEHLHAGMSTLFLVYSNKCQTPLGMAS 2048

2014 GHIRDFQITASGQYGQWAPKLARLHYSGSINAWSTKEPFSWIKVDLLAPM 2063
     |||||||||||||||||||||||||||||||||||||||||||||||||
2049 GHIRDFQITASGQYGQWAPKLARLHYSGSINAWSTKEPFSWIKVDLLAPM 2098

2064 IIHGIKTQGARQKFSSLYISQFIIMYSLDGKKWQTYRGNSTGTLMVFFGN 2113
     |||||||||||||||||||||||||||||||||||||||||||||||||
2099 IIHGIKTQGARQKFSSLYISQFIIMYSLDGKKWQTYRGNSTGTLMVFFGN 2148

2114 VDSSGIKHNIFNPPIIARYIRLHPTHYSIRSTLRMELMGCDLNSCSMPLG 2163
     |||||||||||||||||||||||||||||||||||||||||||||||||
2149 VDSSGIKHNIFNPPIIARYIRLHPTHYSIRSTLRMELMGCDLNSCSMPLG 2198

2164 MESKAISDAQITASSYFTNMFATWSPSKARLHLQGRSNAWRPQVNNPKEW 2213
     |||||||||||||||||||||||||||||||||||||||||||||||||
2199 MESKAISDAQITASSYFTNMFATWSPSKARLHLQGRSNAWRPQVNNPKEW 2248

2214 LQVDFQKTMKVTGVTTQGVKSLLTSMYVKEFLISSSQDGHQWTLFFQNGK 2263
     |||||||||||||||||||||||||||||||||||||||||||||||||
2249 LQVDFQKTMKVTGVTTQGVKSLLTSMYVKEFLISSSQDGHQWTLFFQNGK 2298

2264 VKVFQGNQDSFTPVVNSLDPPLLTRYLRIHPQSWVHQIALRMEVLGCEAQ 2313
     |||||||||||||||||||||||||||||||||||||||||||||||||
2299 VKVFQGNQDSFTPVVNSLDPPLLTRYLRIHPQSWVHQIALRMEVLGCEAQ 2348

2314 DLY                                               2316
     |||
2349 DLY                                               2351
```

Alignment of: HUMFVIII_PEA_1_P11 (SEQ ID NO:767) x FA8_HUMAN (SEQ ID NO:768) ..

```
    14 ATRRYYLGAVELSWDYMQSDLGELPVDARFPPRVPKSFPFNTSVVYKKTL  63
       |||||||||||||||||||||||||||||||||||||||||||||||||
    20 ATRRYYLGAVELSWDYMQSDLGELPVDARFPPRVPKSFPFNTSVVYKKTL  69

64 FVEFTDHLFNIAKPRPPWMGLLGPTIQAEVYDTVVITLKNMASHPVSLHA 113
       |||||||||||||||||||||||||||||||||||||||||||||||||
    70 FVEFTDHLFNIAKPRPPWMGLLGPTIQAEVYDTVVITLKNMASHPVSLHA 119

114 VGVSYWKASEGAEYDDQTSQREKEDDKVFPGGSHTYVWQVLKENGPMASD 163
       |||||||||||||||||||||||||||||||||||||||||||||||||
   120 VGVSYWKASEGAEYDDQTSQREKEDDKVFPGGSHTYVWQVLKENGPMASD 169

164 PLCLTYSYLSHVDLVKDLNSGLIGALLVCREGSLAKEKTQTLHKFILLFA 213
       |||||||||||||||||||||||||||||||||||||||||||||||||
   170 PLCLTYSYLSHVDLVKDLNSGLIGALLVCREGSLAKEKTQTLHKFILLFA 219

214 VFDEGKSWHSETKNSLMQDRDAASARAWPKMHTVNGYVNRSLPGLIGCHR 263
       |||||||||||||||||||||||||||||||||||||||||||||||||
   220 VFDEGKSWHSETKNSLMQDRDAASARAWPKMHTVNGYVNRSLPGLIGCHR 269

264 KSVYWHVIGMGTTPEVHSIFLEGHTFLVRNHRQASLEISPITFLTAQTLL 313
       |||||||||||||||||||||||||||||||||||||||||||||||||
   270 KSVYWHVIGMGTTPEVHSIFLEGHTFLVRNHRQASLEISPITFLTAQTLL 319

314 MDLGQFLLFCHISSHQHDGMEAYVKVDSCPEEPQLRMKNNEEAEDYDDDL 363
       |||||||||||||||||||||||||||||||||||||||||||||||||
   320 MDLGQFLLFCHISSHQHDGMEAYVKVDSCPEEPQLRMKNNEEAEDYDDDL 369

364 TDSEMDVVRFDDDNSPSFIQIRSVAKKHPKTWVHYIAAEEEDWDYAPLVL 413
       |||||||||||||||||||||||||||||||||||||||||||||||||
   370 TDSEMDVVRFDDDNSPSFIQIRSVAKKHPKTWVHYIAAEEEDWDYAPLVL 419

414 APDDRSYKSQYLNNGPQRIGRKYKKVRFMAYTDETFKTREAIQHESGILG 463
       |||||||||||||||||||||||||||||||||||||||||||||||||
   420 APDDRSYKSQYLNNGPQRIGRKYKKVRFMAYTDETFKTREAIQHESGILG 469
```

```
464  PLLYGEVGDTLLIIFKNQASRPYNIYPHGITDVRPLYSRRLPKGVKHLKD  513
     ||||||||||||||||||||||||||||||||||||||||||||||||||
470  PLLYGEVGDTLLIIFKNQASRPYNIYPHGITDVRPLYSRRLPKGVKHLKD  519

514  FPILPGEIFKYKWTVTVEDGPTKSDPRCLTRYYSSFVNMERDLASGLIGP  563
     ||||||||||||||||||||||||||||||||||||||||||||||||||
520  FPILPGEIFKYKWTVTVEDGPTKSDPRCLTRYYSSFVNMERDLASGLIGP  569

564  LLICYKESVDQRGNQIMSDKRNVILFSVFDENRSWYLTENIQRFLPNPAG  613
     ||||||||||||||||||||||||||||||||||||||||||||||||||
570  LLICYKESVDQRGNQIMSDKRNVILFSVFDENRSWYLTENIQRFLPNPAG  619

614  VQLEDPEFQASNIMHSINGYVFDSLQLSVCLHEVAYWYILSIGAQTDFLS  663
     ||||||||||||||||||||||||||||||||||||||||||||||||||
620  VQLEDPEFQASNIMHSINGYVFDSLQLSVCLHEVAYWYILSIGAQTDFLS  669

664  VFFSGYTFKHKMVYEDTLTLFPFSGETVFMSMENPGLWILGCHNSDFRNR  713
     ||||||||||||||||||||||||||||||||||||||||||||||||||
670  VFFSGYTFKHKMVYEDTLTLFPFSGETVFMSMENPGLWILGCHNSDFRNR  719

714  GMTALLKVSSCDKNTGDYYEDSYEDISAYLLSKNNAIEPRSFSQNSRHPS  763
     ||||||||||||||||||||||||||||||||||||||||||||||||||
720  GMTALLKVSSCDKNTGDYYEDSYEDISAYLLSKNNAIEPRSFSQNSRHPS  769

764  TRQKQFNATTIPENDIEKTDPWFAHRTPMPKIQNVSSSDLLMLLRQSPTP  813
     ||||||||||||||||||||||||||||||||||||||||||||||||||
770  TRQKQFNATTIPENDIEKTDPWFAHRTPMPKIQNVSSSDLLMLLRQSPTP  819

814  HGLSLSDLQEAKYETFSDDPSPGAIDSNNSLSEMTHFRPQLHHSGDMVFT  863
     ||||||||||||||||||||||||||||||||||||||||||||||||||
820  HGLSLSDLQEAKYETFSDDPSPGAIDSNNSLSEMTHFRPQLHHSGDMVFT  869

864  PESGLQLRLNEKLGTTAATELKKLDFKVSSTSNNLISTIPSDNLAAGTDN  913
     ||||||||||||||||||||||||||||||||||||||||||||||||||
870  PESGLQLRLNEKLGTTAATELKKLDFKVSSTSNNLISTIPSDNLAAGTDN  919

914  TSSLGPPSMPVHYDSQLDTTLFGKKSSPLTESGGPLSLSEENNDSKLLES  963
     ||||||||||||||||||||||||||||||||||||||||||||||||||
920  TSSLGPPSMPVHYDSQLDTTLFGKKSSPLTESGGPLSLSEENNDSKLLES  969
```

```
 964 GLMNSQESSWGKNVSSTESGRLFKGKRAHGPALLTKDNALFKVSISLLKT 1013
     ||||||||||||||||||||||||||||||||||||||||||||||||||
 970 GLMNSQESSWGKNVSSTESGRLFKGKRAHGPALLTKDNALFKVSISLLKT 1019

1014 NKTSNNSATNRKTHIDGPSLLIENSPSVWQNILESDTEFKKVTPLIHDRM 1063
     ||||||||||||||||||||||||||||||||||||||||||||||||||
1020 NKTSNNSATNRKTHIDGPSLLIENSPSVWQNILESDTEFKKVTPLIHDRM 1069

1064 LMDKNATALRLNHMSNKTTSSKNMEMVQQKKEGPIPPDAQNPDMSFFKML 1113
     ||||||||||||||||||||||||||||||||||||||||||||||||||
1070 LMDKNATALRLNHMSNKTTSSKNMEMVQQKKEGPIPPDAQNPDMSFFKML 1119

1114 FLPESARWIQRTHGKNSLNSGQGPSPKQLVSLGPEKSVEGQNFLSEKNKV 1163
     ||||||||||||||||||||||||||||||||||||||||||||||||||
1120 FLPESARWIQRTHGKNSLNSGQGPSPKQLVSLGPEKSVEGQNFLSEKNKV 1169

1164 VVGKGEFTKDVGLKEMVFPSSRNLFLTNLDNLHENNTHNQEKKIQEEIEK 1213
     ||||||||||||||||||||||||||||||||||||||||||||||||||
1170 VVGKGEFTKDVGLKEMVFPSSRNLFLTNLDNLHENNTHNQEKKIQEEIEK 1219

1214 KETLIQENVVLPQIHTVTGTKNFMKNLFLLSTRQNVEGSYDGAYAPVLQD 1263
     ||||||||||||||||||||||||||||||||||||||||||||||||||
1220 KETLIQENVVLPQIHTVTGTKNFMKNLFLLSTRQNVEGSYDGAYAPVLQD 1269

1264 FRSLNDSTNRTKKHTAHFSKKGEEENLEGLGNQTKQIVEKYACTTRISPN 1313
     ||||||||||||||||||||||||||||||||||||||||||||||||||
1270 FRSLNDSTNRTKKHTAHFSKKGEEENLEGLGNQTKQIVEKYACTTRISPN 1319

1314 TSQQNFVTQRSKRALKQFRLPLEETELEKRIIVDDTSTQWSKNMKHLTPS 1363
     ||||||||||||||||||||||||||||||||||||||||||||||||||
1320 TSQQNFVTQRSKRALKQFRLPLEETELEKRIIVDDTSTQWSKNMKHLTPS 1369

1364 TLTQIDYNEKEKGAITQSPLSDCLTRSHSIPQANRSPLPIAKVSSFPSIR 1413
     ||||||||||||||||||||||||||||||||||||||||||||||||||
1370 TLTQIDYNEKEKGAITQSPLSDCLTRSHSIPQANRSPLPIAKVSSFPSIR 1419

1414 PIYLTRVLFQDNSSHLPAASYRKKDSGVQESSHFLQGAKKNNLSLAILTL 1463
     ||||||||||||||||||||||||||||||||||||||||||||||||||
1420 PIYLTRVLFQDNSSHLPAASYRKKDSGVQESSHFLQGAKKNNLSLAILTL 1469
```

```
1464 EMTGDQREVGSLGTSATNSVTYKKVENTVLPKPDLPKTSGKVELLPKVHI 1513
     ||||||||||||||||||||||||||||||||||||||||||||||||||
1470 EMTGDQREVGSLGTSATNSVTYKKVENTVLPKPDLPKTSGKVELLPKVHI 1519

1514 YQKDLFPTETSNGSPGHLDLVEGSLLQGTEGAIKWNEANRPGKVPFLRVA 1563
     ||||||||||||||||||||||||||||||||||||||||||||||||||
1520 YQKDLFPTETSNGSPGHLDLVEGSLLQGTEGAIKWNEANRPGKVPFLRVA 1569

1564 TESSAKTPSKLLDPLAWDNHYGTQIPKEEWKSQEKSPEKTAFKKKDTILS 1613
     ||||||||||||||||||||||||||||||||||||||||||||||||||
1570 TESSAKTPSKLLDPLAWDNHYGTQIPKEEWKSQEKSPEKTAFKKKDTILS 1619

1614 LNACESNHAIAAINEGQNKPEIEVTWAKQGRTERLCSQNPPVLKRHQREI 1663
     ||||||||||||||||||||||||||||||||||||||||||||||||||
1620 LNACESNHAIAAINEGQNKPEIEVTWAKQGRTERLCSQNPPVLKRHQREI 1669

1664 TRTTLQSDQEEIDYDDTISVEMKKEDFDIYDEDENQSPRSFQKKTRHYFI 1713
     ||||||||||||||||||||||||||||||||||||||||||||||||||
1670 TRTTLQSDQEEIDYDDTISVEMKKEDFDIYDEDENQSPRSFQKKTRHYFI 1719

1714 AAVERLWDYGMSSSPHVLRNRAQSGSVPQFKKVVFQEFTDGSFTQPLYRG 1763
     ||||||||||||||||||||||||||||||||||||||||||||||||||
1720 AAVERLWDYGMSSSPHVLRNRAQSGSVPQFKKVVFQEFTDGSFTQPLYRG 1769

1764 ELNEHLGLLGPYIRAEVEDNIMVTFRNQASRPYSFYSSLISYEEDQRQGA 1813
     ||||||||||||||||||||||||||||||||||||||||||||||||||
1770 ELNEHLGLLGPYIRAEVEDNIMVTFRNQASRPYSFYSSLISYEEDQRQGA 1819

1814 EPRKNFVKPNETKTYFWKVQHHMAPTKDEFDCKAWAYFSDVDLEKDVHSG 1863
     ||||||||||||||||||||||||||||||||||||||||||||||||||
1820 EPRKNFVKPNETKTYFWKVQHHMAPTKDEFDCKAWAYFSDVDLEKDVHSG 1869

1864 LIGPLLVCHTNTLNPAHGRQVTVQEFALFFTIFDETKSWYFTENMERNCR 1913
     ||||||||||||||||||||||||||||||||||||||||||||||||||
1870 LIGPLLVCHTNTLNPAHGRQVTVQEFALFFTIFDETKSWYFTENMERNCR 1919

1914 APCNIQMEDPTFKENYRFHAINGYIMDTLPGLVMAQDQRIRWYLLSMGSN 1963
     ||||||||||||||||||||||||||||||||||||||||||||||||||
1920 APCNIQMEDPTFKENYRFHAINGYIMDTLPGLVMAQDQRIRWYLLSMGSN 1969
```

```
1964  ENIHSIHFSGHVFTVRKKEEYKMALYNLYPGVFETVEMLPSKAGIWRVEC  2013
      ||||||||||||||||||||||||||||||||||||||||||||||||||
1970  ENIHSIHFSGHVFTVRKKEEYKMALYNLYPGVFETVEMLPSKAGIWRVEC  2019

2014  LIGEHLHAGMSTLFLVYSNKCQTPLGMASGHIRDFQITASGQYGQWAPKL  2063
      ||||||||||||||||||||||||||||||||||||||||||||||||||
2020  LIGEHLHAGMSTLFLVYSNKCQTPLGMASGHIRDFQITASGQYGQWAPKL  2069

2064  ARLHYSGSINAWSTKEPFSWIKVDLLAPMIIHGIKTQGARQKFSSLYISQ  2113
      ||||||||||||||||||||||||||||||||||||||||||||||||||
2070  ARLHYSGSINAWSTKEPFSWIKVDLLAPMIIHGIKTQGARQKFSSLYISQ  2119

2114  FIIMYSLDGKKWQTYRGNSTGTLMVFFGNVDSSGIKHNIFNPPIIARYIR  2163
      ||||||||||||||||||||||||||||||||||||||||||||||||||
2120  FIIMYSLDGKKWQTYRGNSTGTLMVFFGNVDSSGIKHNIFNPPIIARYIR  2169

2164  LHPTHYSIRSTLRMELMGCDLNSCSMPLGMESKAISDAQITASSYFTNMF  2213
      ||||||||||||||||||||||||||||||||||||||||||||||||||
2170  LHPTHYSIRSTLRMELMGCDLNSCSMPLGMESKAISDAQITASSYFTNMF  2219

2214  ATWSPSKARLHLQGRSNAWRPQVNNPKEWLQVDFQKTMKVTGVTTQGVKS  2263
      ||||||||||||||||||||||||||||||||||||||||||||||||||
2220  ATWSPSKARLHLQGRSNAWRPQVNNPKEWLQVDFQKTMKVTGVTTQGVKS  2269

2264  LLTSMYVKEFLISSSQDGHQWTLFFQNGKVKVFQGNQDSFTPVVNSLDPP  2313
      ||||||||||||||||||||||||||||||||||||||||||||||||||
2270  LLTSMYVKEFLISSSQDGHQWTLFFQNGKVKVFQGNQDSFTPVVNSLDPP  2319

2314  LLTRYLRIHPQSWVHQIALRMEVLGCEAQDLY                    2345
      ||||||||||||||||||||||||||||||||
2320  LLTRYLRIHPQSWVHQIALRMEVLGCEAQDLY                    2351
```

FIGURE 178

Alignment of: HUMFVIII_PEA_1_P13 (SEQ ID NO:768) x FA8_HUMAN (SEQ ID NO:769)

```
 14 FPPRVPKSFPFNTSVVYKKTLFVEFTDHLFNIAKPRPPWMGLLGPTIQAE  63
    ||||||||||||||||||||||||||||||||||||||||||||||||||
 49 FPPRVPKSFPFNTSVVYKKTLFVEFTDHLFNIAKPRPPWMGLLGPTIQAE  98

64 VYDTVVITLKNMASHPVSLHAVGVSYWKASEGAEYDDQTSQREKEDDKVF 113
    |||||||||||||||||||||||||||||||||||||||||||||||||
 99 VYDTVVITLKNMASHPVSLHAVGVSYWKASEGAEYDDQTSQREKEDDKVF 148

114 PGGSHTYVWQVLKENGPMASDPLCLTYSYLSHVDLVKDLNSGLIGALLVC 163
    |||||||||||||||||||||||||||||||||||||||||||||||||
149 PGGSHTYVWQVLKENGPMASDPLCLTYSYLSHVDLVKDLNSGLIGALLVC 198

164 REGSLAKEKTQTLHKFILLFAVFDEGKSWHSETKNSLMQDRDAASARAWP 213
    |||||||||||||||||||||||||||||||||||||||||||||||||
199 REGSLAKEKTQTLHKFILLFAVFDEGKSWHSETKNSLMQDRDAASARAWP 248

214 KMHTVNGYVNRSLPG                                   228
    |||||||||||||||
249 KMHTVNGYVNRSLPG                                   263
```

FIGURE 179

Alignment of: HUMC1RS_PEA_1_P8 (SEQ ID NO:816) x C1S_HUMAN (SEQ ID NO:821) ..

```
  1 MWCIVLFSLLAWVYAEPTMYGEILSPNYPQAYPSEVEKSWDIEVPEGYGI  50
    ||||||||||||||||||||||||||||||||||||||||||||||||||
  1 MWCIVLFSLLAWVYAEPTMYGEILSPNYPQAYPSEVEKSWDIEVPEGYGI  50

51 HLYFTHLDIELSENCAYDSVQIISGDTEEGRLCGQRSSNNPHSPIVEEFQ 100
    ||||||||||||||||||||||||||||||||||||||||||||||||||
 51 HLYFTHLDIELSENCAYDSVQIISGDTEEGRLCGQRSSNNPHSPIVEEFQ 100

101 VPYNKLQVIFKSDFSNEERFTGFAAYYVATDINECTDFVDVPCSHFCNNF 150
    ||||||||||||||||||||||||||||||||||||||||||||||||||
101 VPYNKLQVIFKSDFSNEERFTGFAAYYVATDINECTDFVDVPCSHFCNNF 150

151 IGGYFCSCPPEYFLHDDMKNCGVNCSGDVFTALIGEIASPNYPKPYPENS 200
    ||||||||||||||||||||||||||||||||||||||||||||||||||
151 IGGYFCSCPPEYFLHDDMKNCGVNCSGDVFTALIGEIASPNYPKPYPENS 200

201 RCEYQIRLEKGFQVVVTLRREDFDVEAADSAGNCLDSLVFVAGDRQFGPY 250
    ||||||||||||||||||||||||||||||||||||||||||||||||||
201 RCEYQIRLEKGFQVVVTLRREDFDVEAADSAGNCLDSLVFVAGDRQFGPY 250

251 CGHGFPGPLNIETKSNALDIIFQTDLTGQKKGWKLRYHGDPMPCPKEDTP 300
    ||||||||||||||||||||||||||||||||||||||||||||||||||
251 CGHGFPGPLNIETKSNALDIIFQTDLTGQKKGWKLRYHGDPMPCPKEDTP 300

301 NSVWEPAKAKYVFRDVVQITCLDGFEVVEGRVGATSFYSTCQSNGKWSNS 350
    ||||||||||||||||||||||||||||||||||||||||||||||||||
301 NSVWEPAKAKYVFRDVVQITCLDGFEVVEGRVGATSFYSTCQSNGKWSNS 350

351 KLKCQPVDCGIPESIENGKVEDPESTLFGSVIRYTCEEPYYYMENGGGGE 400
    ||||||||||||||||||||||||||||||||||||||||||||||||||
351 KLKCQPVDCGIPESIENGKVEDPESTLFGSVIRYTCEEPYYYMENGGGGE 400

401 YHCAGNGSWVNEVLGPELPKCVP                             423
    |||||||||||||||||||||||
401 YHCAGNGSWVNEVLGPELPKCVP                             423
```

FIGURE 180

Alignment of: HUMC1RS_PEA_1_P21 (SEQ ID NO:817) x C1S_HUMAN (SEQ ID NO:821)

```
  1 MWCIVLFSLLAWVYAEPTMYGEILSPNYPQAYPSEVEKSWDIEVPEGYGI  50
    ||||||||||||||||||||||||||||||||||||||||||||||||||
  1 MWCIVLFSLLAWVYAEPTMYGEILSPNYPQAYPSEVEKSWDIEVPEGYGI  50

51 HLYFTHLDIELSENCAYDSVQIISGDTEEGRLCGQRSSNNPHSPIVEEFQ 100
    ||||||||||||||||||||||||||||||||||||||||||||||||||
 51 HLYFTHLDIELSENCAYDSVQIISGDTEEGRLCGQRSSNNPHSPIVEEFQ 100

101 VPYNKLQVIFKSDFSNEERFTGFAAYYVATDINECTDFVDVPCSHFCNNF 150
    ||||||||||||||||||||||||||||||||||||||||||||||||||
101 VPYNKLQVIFKSDFSNEERFTGFAAYYVATDINECTDFVDVPCSHFCNNF 150

151 IGGYFCSCPPEYFLHDDMKNCGVNCSGDVFTALIGEIASPNYPKPYPENS 200
    ||||||||||||||||||||||||||||||||||||||||||||||||||
151 IGGYFCSCPPEYFLHDDMKNCGVNCSGDVFTALIGEIASPNYPKPYPENS 200

201 RCEYQIRLEKGFQVVVTLRREDFDVEAADSAGNCLDSLVFVAGDRQFGPY 250
    ||||||||||||||||||||||||||||||||||||||||||||||||||
201 RCEYQIRLEKGFQVVVTLRREDFDVEAADSAGNCLDSLVFVAGDRQFGPY 250

251 CGHGFPGPLNIETKSNALDIIFQTDLTGQKKGWKLRYHGDPMPCPKEDTP 300
    ||||||||||||||||||||||||||||||||||||||||||||||||||
251 CGHGFPGPLNIETKSNALDIIFQTDLTGQKKGWKLRYHGDPMPCPKEDTP 300

301 NSVWEPAKAKYVFRDVVQITCLDGFEVVEGRVGATSFYSTCQSNGKWSNS 350
    ||||||||||||||||||||||||||||||||||||||||||||||||||
301 NSVWEPAKAKYVFRDVVQITCLDGFEVVEGRVGATSFYSTCQSNGKWSNS 350

351 KLKCQ                                             355
    |||||
351 KLKCQ                                             355
```

Alignment of: HUMC1RS_PEA_1_P22 (SEQ ID NO:818) x C1S_HUMAN (SEQ ID NO:821)

```
  1 MWCIVLFSLLAWVYAEPTMYGEILSPNYPQAYPSEVEKSWDIEVPEGYGI  50
    ||||||||||||||||||||||||||||||||||||||||||||||||||
  1 MWCIVLFSLLAWVYAEPTMYGEILSPNYPQAYPSEVEKSWDIEVPEGYGI  50

51 HLYFTHLDIELSENY...................................  65
    |||||||||||||||
 51 HLYFTHLDIELSENCAYDSVQIISGDTEEGRLCGQRSSNNPHSPIVEEFQ 100

66 ...............................INECTDFVDVPCSHFCNNF  84
                                   |||||||||||||||||||
101 VPYNKLQVIFKSDFSNEERFTGFAAYYVATDINECTDFVDVPCSHFCNNF 150

85 IGGYFCSCPPEYFLHDDMKNCGVNCSGDVFTALIGEIASPNYPKPYPENS 134
    ||||||||||||||||||||||||||||||||||||||||||||||||||
151 IGGYFCSCPPEYFLHDDMKNCGVNCSGDVFTALIGEIASPNYPKPYPENS 200

135 RCEYQIRLEKGFQVVVTLRREDFDVEAADSAGNCLDSLVFVAGDRQFGPY 184
    ||||||||||||||||||||||||||||||||||||||||||||||||||
201 RCEYQIRLEKGFQVVVTLRREDFDVEAADSAGNCLDSLVFVAGDRQFGPY 250

185 CGHGFPGPLNIETKSNALDIIFQTDLTGQKKGWKLRYHGDPMPCPKEDTP 234
    ||||||||||||||||||||||||||||||||||||||||||||||||||
251 CGHGFPGPLNIETKSNALDIIFQTDLTGQKKGWKLRYHGDPMPCPKEDTP 300

235 NSVWEPAKAKYVFRDVVQITCLDGFEVVEGRVGATSFYSTCQSNGKWSNS 284
    ||||||||||||||||||||||||||||||||||||||||||||||||||
301 NSVWEPAKAKYVFRDVVQITCLDGFEVVEGRVGATSFYSTCQSNGKWSNS 350

285 KLKCQPVDCGIPESIENGKVEDPESTLFGSVIRYTCEEPYYYMENGGGGE 334
    ||||||||||||||||||||||||||||||||||||||||||||||||||
351 KLKCQPVDCGIPESIENGKVEDPESTLFGSVIRYTCEEPYYYMENGGGGE 400

335 YHCAGNGSWVNEVLGPELPKCVPVCGVPREPFEEKQRIIGGSDADIKNFP 384
    ||||||||||||||||||||||||||||||||||||||||||||||||||
401 YHCAGNGSWVNEVLGPELPKCVPVCGVPREPFEEKQRIIGGSDADIKNFP 450
```

```
385 WQVFFDNPWAGGALINEYWVLTAAHVVEGNREPTMYVGSTSVQTSRLAKS 434
    ||||||||||||||||||||||||||||||||||||||||||||||||||
451 WQVFFDNPWAGGALINEYWVLTAAHVVEGNREPTMYVGSTSVQTSRLAKS 500

435 KMLTPEHVFIHPGWKLLEVPEGRTNFDNDIALVRLKDPVKMGPTVSPICL 484
    ||||||||||||||||||||||||||||||||||||||||||||||||||
501 KMLTPEHVFIHPGWKLLEVPEGRTNFDNDIALVRLKDPVKMGPTVSPICL 550

485 PGTSSDYNLMDGDLGLISGWGRTEKRDRAVRLKAARLPVAPLRKCKEVKV 534
    ||||||||||||||||||||||||||||||||||||||||||||||||||
551 PGTSSDYNLMDGDLGLISGWGRTEKRDRAVRLKAARLPVAPLRKCKEVKV 600

535 EKPTADAEAYVFTPNMICAGGEKGMDSCKGDSGGAFAVQDPNDKTKFYAA 584
    ||||||||||||||||||||||||||||||||||||||||||||||||||
601 EKPTADAEAYVFTPNMICAGGEKGMDSCKGDSGGAFAVQDPNDKTKFYAA 650

585 GLVSWGPQCGTYGLYTRVKNYVDWIMKTMQENSTPRED             622
    |||||||||||||||||||||||||||||||||||||
651 GLVSWGPQCGTYGLYTRVKNYVDWIMKTMQENSTPRED             688
```

FIGURE 182

Alignment of: HUMC1RS_PEA_1_P23 (SEQ ID NO:819) x C1S_HUMAN (SEQ ID NO:821)

```
  1 MWCIVLFSLLAWVYAEPTMYGEILSPNYPQAYPSEVEKSWDIEVPEGYGI  50
    ||||||||||||||||||||||||||||||||||||||||||||||||||
  1 MWCIVLFSLLAWVYAEPTMYGEILSPNYPQAYPSEVEKSWDIEVPEGYGI  50

51 HLYFTHLDIELSENCAYDSVQIISGDTEEGRLCGQRSSNNPHSPIVEEFQ 100
    ||||||||||||||||||||||||||||||||||||||||||||||||||
 51 HLYFTHLDIELSENCAYDSVQIISGDTEEGRLCGQRSSNNPHSPIVEEFQ 100

101 VPYNKLQVIFKSDFSNEERFTGFAAYYVATDINECTDFVDVPCSHFCNNF 150
    ||||||||||||||||||||||||||||||||||||||||||||||||||
101 VPYNKLQVIFKSDFSNEERFTGFAAYYVATDINECTDFVDVPCSHFCNNF 150

151 IGGYFCSCPPEYFLHDDMKNCGVNCSGDVFTALIGEIASPNYPKPYPENS 200
    ||||||||||||||||||||||||||||||||||||||||||||||||||
151 IGGYFCSCPPEYFLHDDMKNCGVNCSGDVFTALIGEIASPNYPKPYPENS 200

201 RCEYQIRLEKGFQVVVTLRREDFDVEAADSAGNCLDSLVFVAGDRQFGPY 250
    ||||||||||||||||||||||||||||||||||||||||||||||||||
201 RCEYQIRLEKGFQVVVTLRREDFDVEAADSAGNCLDSLVFVAGDRQFGPY 250

251 CGHGFPGPLNIETKSNALDIIFQTDLTGQKKGWKLRYHGD           290
    |||||||||||||||||||||||||||||||||||||||
251 CGHGFPGPLNIETKSNALDIIFQTDLTGQKKGWKLRYHGD           290
```

FIGURE 183

Alignment of: HUMC1RS_PEA_1_P24 (SEQ ID NO:820) x C1S_HUMAN (SEQ ID NO:821)

```
  1 MWCIVLFSLLAWVYAEPTMYGEILSPNYPQAYPSEVEKSWDIEVPEGYGI 50
    |||||||||||||||||||||||||||||||||||||||||||||||||
  1 MWCIVLFSLLAWVYAEPTMYGEILSPNYPQAYPSEVEKSWDIEVPEGYGI 50

51 HLYFTHLDIELSENCAYDSVQIISGDTEEGRLCGQRSSNNPHSPIVEEFQ 100
    |||||||||||||||||||||||||||||||||||||||||||||||||
 51 HLYFTHLDIELSENCAYDSVQIISGDTEEGRLCGQRSSNNPHSPIVEEFQ 100

101 VPYNKLQVIFKSDFSNEERFTGFAAYYVATDINECTDFVDVPCSHFCNNF 150
    |||||||||||||||||||||||||||||||||||||||||||||||||
101 VPYNKLQVIFKSDFSNEERFTGFAAYYVATDINECTDFVDVPCSHFCNNF 150

151 IGGYFCSCPPEYFLHDDMKNCGVNCSGDVFTALIGEIASPNYPKPYPENS 200
    |||||||||||||||||||||||||||||||||||||||||||||||||
151 IGGYFCSCPPEYFLHDDMKNCGVNCSGDVFTALIGEIASPNYPKPYPENS 200

201 RCEYQIRLEKGFQVVVTLRREDFDVEAADSAGNCLDSLVFVAGDRQFGPY 250
    |||||||||||||||||||||||||||||||||||||||||||||||||
201 RCEYQIRLEKGFQVVVTLRREDFDVEAADSAGNCLDSLVFVAGDRQFGPY 250

251 CGHGFPGPLNIETKSNALDIIFQTDLTGQKKGWKLRYHGDPMPCPKEDTP 300
    |||||||||||||||||||||||||||||||||||||||||||||||||
251 CGHGFPGPLNIETKSNALDIIFQTDLTGQKKGWKLRYHGDPMPCPKEDTP 300

301 NSVWEPAKAKYVFRDVVQITCLDGFEVVE                     329
    |||||||||||||||||||||||||||||
301 NSVWEPAKAKYVFRDVVQITCLDGFEVVE                     329
```

FIGURE 184

Alignment of: HSGROW1_PEA_1_P7 (SEQ ID NO:851) x SOMA_HUMAN (SEQ ID NO:850)

```
  1 MATGSRTSLLLAFGLLCLPWLQEGSAFPTIPLSRLFDNAMLRAHRLHQLA  50
    ||||||||||||||||||||||||||||||||||||||||||||||||||
  1 MATGSRTSLLLAFGLLCLPWLQEGSAFPTIPLSRLFDNAMLRAHRLHQLA  50

51 FDTYQEF................TSLCFSESIPTPSNREETQQKSNLE  82
    |||||||                 ||||||||||||||||||||||||
 51 FDTYQEFEEAYIPKEQKYSFLQNPQTSLCFSESIPTPSNREETQQKSNLE 100

83 LLRISLLLIQSWLEPVQFLRSVFANSLVYGASDSNVYDLLKDLEEGIQTL 132
    ||||||||||||||||||||||||||||||||||||||||||||||||||
101 LLRISLLLIQSWLEPVQFLRSVFANSLVYGASDSNVYDLLKDLEEGIQTL 150

133 MGRLEDGSPRTGQIFKQTYSKFDTNSHNDDALLKNYGLLYCFRKDMDKVE 182
    ||||||||||||||||||||||||||||||||||||||||||||||||||
151 MGRLEDGSPRTGQIFKQTYSKFDTNSHNDDALLKNYGLLYCFRKDMDKVE 200

183 TFLRIVQCRSVEGSCGF                                 199
    |||||||||||||||||
201 TFLRIVQCRSVEGSCGF                                 217
```

FIGURE 185

Alignment of: HSGROW1_PEA_1_P11 (SEQ ID NO:852) x SOMA_HUMAN (SEQ ID NO:850)

```
  1 MATGSRTSLLLAFGLLCLPWLQEGSAFPTIPLSRLFDNAMLRAHRLHQLA  50
    ||||||||||||||||||||||||||||||||||||||||||||||||||
  1 MATGSRTSLLLAFGLLCLPWLQEGSAFPTIPLSRLFDNAMLRAHRLHQLA  50

51 FDTYQEFEEAYIPKEQKYSFLQNPQTSLCFSESIPTPSNREETQQKSNLE 100
    ||||||||||||||||||||||||||||||||||||||||||||||||||
 51 FDTYQEFEEAYIPKEQKYSFLQNPQTSLCFSESIPTPSNREETQQKSNLE 100

101 LLRISLLLIQSWLEPVQFLRSVFANSLVYGASDSNVYDLLKDLEEGIQTL 150
    ||||||||||||||||||||||||||||||||||||||||||||||||||
101 LLRISLLLIQSWLEPVQFLRSVFANSLVYGASDSNVYDLLKDLEEGIQTL 150

Alignment of: HSGROW1_PEA_1_P12 (SEQ ID NO:853) x SOMA_HUMAN (SEQ ID NO:850)

```
  1 MATGSRTSLLLAFGLLCLPWLQEGSAFPTIPLSRLFDNAMLRAHRLHQLA  50
    ||||||||||||||||||||||||||||||||||||||||||||||||||
  1 MATGSRTSLLLAFGLLCLPWLQEGSAFPTIPLSRLFDNAMLRAHRLHQLA  50

51 FDTYQEFEEAYIPKEQKYSFLQNPQTSLCFSESIPTPSNREETQQKSNLE 100
    ||||||||||||||||||||||||||||||||||||||||||||||||||
 51 FDTYQEFEEAYIPKEQKYSFLQNPQTSLCFSESIPTPSNREETQQKSNLE 100

101 LLRISLLLIQSWLEPVQFLRSVFANSLVYGASDSNVYDLLKDLEEGIQTL 150
    ||||||||||||||||||||||||||||||||||||||||||||||||||
101 LLRISLLLIQSWLEPVQFLRSVFANSLVYGASDSNVYDLLKDLEEGIQTL 150

Alignment of: HSGROW1_PEA_1_P18 (SEQ ID NO:854) x SOMA_HUMAN (SEQ ID NO:850)

```
  1 MATGSRTSLLLAFGLLCLPWLQEGSAFPTIPLSRLFDNAMLRAHRLHQLA  50
    ||||||||||||||||||||||||||||||||||||||||||||||||||
  1 MATGSRTSLLLAFGLLCLPWLQEGSAFPTIPLSRLFDNAMLRAHRLHQLA  50

51 FDTYQEF..........................................  57
    |||||||
 51 FDTYQEFEEAYIPKEQKYSFLQNPQTSLCFSESIPTPSNREETQQKSNLE 100

57 ..................................................  57

101 LLRISLLLIQSWLEPVQFLRSVFANSLVYGASDSNVYDLLKDLEEGIQTL 150

58 ..RLEDGSPRTGQIFKQTYSKFDTNSHNDDALLKNYGLLYCFRKDMDKVE 105
      |||||||||||||||||||||||||||||||||||||||||||||||||
151 MGRLEDGSPRTGQIFKQTYSKFDTNSHNDDALLKNYGLLYCFRKDMDKVE 200

106 TFLRIVQCRSVEGSCGF                                  122
    |||||||||||||||||
201 TFLRIVQCRSVEGSCGF                                  217
```

FIGURE 188

Alignment of: HSGROW1_PEA_1_P21 (SEQ ID NO:855) x SOMA_HUMAN (SEQ ID NO:850)

```
  1 MATGSRTSLLLAFGLLCLPWLQEGSAFPTIPLSRLFDNAMLRAHRLHQLA  50
    ||||||||||||||||||||||||||||||||||||||||||||||||||
  1 MATGSRTSLLLAFGLLCLPWLQEGSAFPTIPLSRLFDNAMLRAHRLHQLA  50

51 FDTYQEF                                             57
    |||||||
 51 FDTYQEF                                             57
```

Figure 189

Structure of C5 and its variants

| | | | | |
|---|---|---|---|---|
| W.T | SP | a2-macroglobulin 19-673 | Anaphil otoxin-like 678-751 | a2-macroglobulin 752-1531 | NTR 1532-1676 |

Convertase binding sites
Convertase cleavage site Arg733
C5a peptidase cleavage site T11: SP | a2-macroglobulin 19-673 | Anaphil otoxin-like 678-751 | a2-macroglobulin 752-801 — New exon (20A), 87 a.a.

T16: SP | a2-macroglobulin 19-292 — 5 a.a. New exon (8A)

T14: SP | a2-macroglobulin 19-502 | 1348-1350 — Intron 12 retention

Figure 190

Factor VIII – Launched Products

| Company | Product (All are haemostatic) | Status and comments |
|---|---|---|
| Baxter | Recombinate rh factor VIII | 2002 sales: $895 million |
| Bayer (Genentech) | Kogenate rh factor VIII | 2002 sales: $400 million<br>Orphan drug for haemophilia A |
| Aventis | Monoclate P factor VIII | 2002 sales: $330 million; MAb purification |
| Baxter | Hemophil M factor VIII | 2002 sales: $300 million |
| Baxter | Advate | 3rd generation, all proteins excluded<br>Launched 2003 in US, 2004 Europe |
| Bayer | Factor VIII factor VIII (Kogenate FS). | 2002 sales: $185 million<br>2nd-generation, no albumin, yes sucrose |
| Aventis (Bayer) | Helixate rh factor VIII (=Kogenate FS) | 2002 sales: $72 million |
| Aventis | Bioclate rh factor VIII | 2002 sales: $72 million |
| Ipsen | Hyate C antihaemophilic factor (Factor VIIIc) | highly purified porcine |
| Wyeth | moroctocog alfa (ReFacto) | 2nd-generation B-domain deleted recombinant Factor VIII albumin-free<br>2002 sales: $198 million |

Figure 191

Factor VIII – Related Developments

| Company | Candidate | Phase | Indication | Status and comments |
|---------|-----------|-------|------------|---------------------|
| Genmab  |           | preclinical |      | human MAbs which prevent binding of inhibitory antibodies to Factor VIII |

Figure 192

Factor VIII – Clinical/Preclinical Developments

| Company | Candidate | Phase | Indication | Status and comments |
|---|---|---|---|---|
| Ipsen-Octagen | OBI-1 rpfVIII | entering II | Haemophilics w neutralizing Abs | B-domain deleted, recombinant, porcine sequence Factor VIII |
| Bayer- Zilip-Pharma | Longer-acting Kogenate | early | | Liposome technology |
| Omri-Bayer | Long acting Fa8 | early | | |
| Octagene | BDDhFVIII gene therapy | Preclin.I | | Oral B-domain deleted factor VIII |
| Oxford BioMedica | Requinate Gene therpay | Preclin. | | Recently received funding for this product |
| Targeted Genetics (w Wyeth) | B-domain deleted human factor VIII gene therapy | Preclin. | haemostatic | Very early if active at all |
| Sertoli | Hemaphix Gene therapy | Preclin. | | Very early if active at all |
| TheraCyte | HemA sc implant | Preclin. | | Not on company website |

Complement pathways

Figure 195

C5 – Clinical Developments

| Company | Candidate | Phase | Indication | Status and comments |
|---|---|---|---|---|
| Alexion | eculizumab | III | paroxysmal nocturnal hemoglobinuria (PNH) | a humanized MAb that prevents the cleavage of C5 into its components; Orphan drug in PNH (US, EU) Analysts projection: PNH US+EU 2009 sales = $150M |
| | | IIb complete | RA, nephritis, dermatomyositis | |
| Alexion | Pexelizumab | III | cardiopulmonary bypass graft surgery (CPB); | Pexelizumab is a fragment of an anti-C5 antibody; Analysts projection: US+EU 2009 sales in CABG = $184M |
| | | II | Acute MI | |
| Neurogen | NGD 2000-1 | IIa complete | RA | C5a receptor antagonist |
| Promics | PMX53 | II | RA | small molecule C5a receptor antagonist derived from the C-terminus of C5a |
| Millennium-Xoma | MLN2222 | I | Coronary Artery Bypass Graft (CABG) surgery | recombinant protein that blocks both the C3 and C5 convertases |

Figure 196

C5 –Preclinical Developments

| Company | Candidate | Indication | Status and comments |
|---|---|---|---|
| Inflazyme | CD59-Prodaptin™ | paroxysmal nocturnal hemoglobinuria (PNH) | interrupts the formation of the "membrane attack complex" |

Figure 197

CR1 – Clinical Developments

| Company | Candidate | Phase | Indication | Status and comments |
|---|---|---|---|---|
| Avant | TP10 | II | ARDS*; cardiopulmonary bypass surgery reperfusion injury | recombinant soluble complement receptor type-1; US orphan drug status for ARDS and reperfusion injury |
| Inflazyme (Adprotech)** | APT070 | I/II | RA | a truncated form of the human Complement Receptor 1 (CR1) linked to a unique Prodaptin™ construct that directs the molecule to the cell membrane and regulates the over-production of complement at the cell surface |

C1s – Clinical Developments

Figure 198a

| Company | Candidate | Phase | Indication | Status and comments |
|---|---|---|---|---|
| Phraming | rhC1INH | III | Hereditary Angioedema | recombinant human C1 inhibitor (rhC1INH) Orphan by EMEA |

Figure 198b

Related drug:

| Company | Candidate | Phase | Indication | Status and comments |
|---|---|---|---|---|
| Jerini peptide Technologies | Icatibant | IND | Hereditary Angioedema | peptidomimetic bradykinin B2 receptor antagonist Orphan by FDA and EMEA |

Figure 200

GH Antagonists – Launched Products

| Company | Product | Indication | Status and comments |
|---|---|---|---|
| Pfizer | Somavert pegvisomant | acromegaly | s.c. injection<br>GH receptor antagonist<br>Uses Nektar technology (PEGylation) |
| Sanofi | Somatostatin | acute gastrointestinal conditions (ulcer bleeding, pancreatitis, etc) | Tested for diabetes but doesn't work. |

Figure 201

GH Antagonists – Clinical Developments

| Company | Candidate | Phase | Indication | Status and comments |
|---|---|---|---|---|
| Debiopharma | SANVAR vapreotide | III | acute esophageal variceal bleeding | Preclinical for ulcer, venostasis<br><br>Orphan drug for acute esophageal variceal bleeding |
| | Somatostatin analog | II | Acromegaly, Diarrhoea Crohn's disease | Subcutaneous implant (in Pharmaprojects, phase III studies in breast, pancreatic and prostate cancer were mentioned but company web site doesn't support data. |

| SP | Ig-like 1 | Ig-like 2 | Ig-like 3 | Ig-like 4 | Ig-like 5 | Ig-like 6 | Ig-like 7 | TM | Cytoplasmic |

1-19, 46-110, 141-207, 224-320, 328-414, 421-548, 551-660, 667-753, 765-789, 790-1356

P678

| SP | Ig-like 1 | Ig-like 2 | Ig-like 3 | Ig-like 4 | Ig-like 5 | Ig-like 6 | 16U |

Exon 13 extension

P469

| SP | Ig-like 1 | Ig-like 2 | Ig-like 3 | Ig-like 4 | 51U |

Exon 9 extension

Figure 204

| | | | | | | | |
|---|---|---|---|---|---|---|---|
| W.T 455 | SP | TNFR C6 | TNFR C6 | TNFR C6 | TNFR C6 | TM | Cytoplasmic/NSD/Death domain |
| | 1-21 | 43-82 | 83-125 | 126-166 | 167-196 | 212-234 | 338-441 |

P218: SP | TNFR C6 | TNFR C6 | TNFR C6 | 35U — New exon 5b (Alu ex)

P228: SP | TNFR C6 | TNFR C6 | TNFR C6 | 45U — Skip exon 6

P247: SP | TNFR C6 | TNFR C6 | TNFR C6 | TNFR C6 | 39U — Skip exon 7+8, cryptic in exon 9

P184: SP | TNFR C6 | TNFR C6 | TNFR C6 | TNFR C6 | 3U — exon 5 3' extension/retention

P242: SP | TNFR C6 | TNFR C6 | TNFR C6 | 59U

Figure 205

Alignment of D45608_P3 (SEQ ID NO:857) to PSPD_HUMAN (SEQ ID NO:858)

```
  1 MLLFLLSALVLLTQPLGYLEAEMKTYSHRTMPSACTLVMCSSVESGLPGR  50
    ||||||||||||||||||||||||||||||||||||||||||||||||||
 16 MLLFLLSALVLLTQPLGYLEAEMKTYSHRTMPSACTLVMCSSVESGLPGR  65

51 DGRDGREGPRGEKGDPGLPGAAGQAGMPGQAGPVGPKGDNGSVGEPGPKG 100
    ||||||||||||||||||||||||||||||||||||||||||||||||||
 66 DGRDGREGPRGEKGDPGLPGAAGQAGMPGQAGPVGPKGDNGSVGEPGPKG 115

101 DTGPS.............................GEVGAP 111
    |||||                              |||||
116 DTGPSGPPGPPGVPGPAGREGPLGKQGNIGPQGKPGPKGEAGPKGEVGAP 165

112 GMQGSAGARGLAGPKGERGVPGERGVPGNTGAAGSAGAMGPQGSPGARGP 161
    ||||||||||||||||||||||||||||||||||||||||||||||||||
166 GMQGSAGARGLAGPKGERGVPGERGVPGNTGAAGSAGAMGPQGSPGARGP 215

162 PGLKGDKGIPGDKGAKGESGLPDVASLRQQVEALQGQVQHLQAAFSQYKK 211
    ||||||||||||||||||||||||||||||||||||||||||||||||||
216 PGLKGDKGIPGDKGAKGESGLPDVASLRQQVEALQGQVQHLQAAFSQYKK 265

212 VELFPNGQSVGEKIFKTAGFVKPFTEAQLLCTQAGGQLASPRSAAENAAL 261
    ||||||||||||||||||||||||||||||||||||||||||||||||||
266 VELFPNGQSVGEKIFKTAGFVKPFTEAQLLCTQAGGQLASPRSAAENAAL 315

262 QQLVVAKNEAAFLSMTDSKTEGKFTYPTGESLVYSNWAPGEPNDDGGSED 311
    ||||||||||||||||||||||||||||||||||||||||||||||||||
316 QQLVVAKNEAAFLSMTDSKTEGKFTYPTGESLVYSNWAPGEPNDDGGSED 365

312 CVEIFTNGKWNDRACGEKRLVVCEF                         336
    |||||||||||||||||||||||||
366 CVEIFTNGKWNDRACGEKRLVVCEF                         390
```

Figure 206

Alignment of: HUMTNFRII_PEA_1_P7 (SEQ ID NO:696) x TR1B_HUMAN (SEQ ID NO:862) ..

```
  1 MAPVAVWAALAVGLELWAAAHALPAQVAFTPYAPEPGSTCRLREYYDQTA  50
    ||||||||||||||||||||||||||||||||||||||||||||||||||
  1 MAPVAVWAALAVGLELWAAAHALPAQVAFTPYAPEPGSTCRLREYYDQTA  50

51 QMCCSKCSPGQHAKVFCTKTSDTVCDSCEDSTYTQLWNWVPECLSCGSRC 100
    ||||||||||||||||||||||||||||||||||||||||||||||||||
 51 QMCCSKCSPGQHAKVFCTKTSDTVCDSCEDSTYTQLWNWVPECLSCGSRC 100

101 SSDQVETQACTREQNRICTCRPGWYCALSKQEGCRLCAPLRKCRPGFGVA 150
    ||||||||||||||||||||||||||||||||||||||||||||||||||
101 SSDQVETQACTREQNRICTCRPGWYCALSKQEGCRLCAPLRKCRPGFGVA 150

151 RPGTETSDVVCKPCAPGTFSNTTSSTDICRPHQICNVVAIPGNASMDAVC 200
    ||||||||||||||||||||||||||||||||||||||||||||||||||
151 RPGTETSDVVCKPCAPGTFSNTTSSTDICRPHQICNVVAIPGNASMDAVC 200

201 TSTSPTRSMAPGAVHLPQPVSTRSQHTQPTPEPSTAPSTSFLLPMGPSPP 250
    ||||||||||||||||||||||||||||||||||||||||||||||||||
201 TSTSPTRSMAPGAVHLPQPVSTRSQHTQPTPEPSTAPSTSFLLPMGPSPP 250

251 AEGSTGDFALPV.....................................  262
    ||||||||||||
251 AEGSTGDFALPVGLIVGVTALGLLIIGVVNCVIMTQVKKKPLCLQREAKV 300

262 .................................................  262

301 PHLPADKARGTQGPEQQHLLITAPSSSSSSLESSASALDRRAPTRNQPQA 350

263 ...................DSSPGGHGTQVNVTCIVNVCSSSDHSSQCSSQ 294
                       ||||||||||||||||||||||||||||||||
351 PGVEASGAGEARASTGSSDSSPGGHGTQVNVTCIVNVCSSSDHSSQCSSQ 400

295 ASSTMGDTDSSPSESPKDEQVPFSKEECAFRSQLETPETLLGSTEEKPLP 344
    ||||||||||||||||||||||||||||||||||||||||||||||||||
401 ASSTMGDTDSSPSESPKDEQVPFSKEECAFRSQLETPETLLGSTEEKPLP 450

345 LGVPDAGMKPS                                        355
    |||||||||||
451 LGVPDAGMKPS                                        461
```

FIGURE 207

Alignment of: HUMTNFRII_PEA_1_P15 (SEQ ID NO:697) x TR1B_HUMAN (SEQ ID NO:862) ..

```
  1 MAPVAVWAALAVGLELWAAAHALPAQ  26
    ||||||||||||||||||||||||||
  1 MAPVAVWAALAVGLELWAAAHALPAQ  26
```

FIGURE 208

Alignment of: HUMTNFRII_PEA_1_P17 (SEQ ID NO:699) x TR1B_HUMAN (SEQ ID NO:862) ..

Alignment segment 1/1:

```
                 Quality: 1573.00           Escore:          0
         Matching length:     152           Total length:  152
Matching Percent Similarity: 100.00  Matching Percent Identity: 100.00
   Total Percent Similarity: 100.00     Total Percent Identity: 100.00
                    Gaps:       0
```

Alignment:

```
  1 MAPVAVWAALAVGLELWAAAHALPAQVAFTPYAPEPGSTCRLREYYDQTA  50
    ||||||||||||||||||||||||||||||||||||||||||||||||||
  1 MAPVAVWAALAVGLELWAAAHALPAQVAFTPYAPEPGSTCRLREYYDQTA  50

51 QMCCSKCSPGQHAKVFCTKTSDTVCDSCEDSTYTQLWNWVPECLSCGSRC 100
    ||||||||||||||||||||||||||||||||||||||||||||||||||
 51 QMCCSKCSPGQHAKVFCTKTSDTVCDSCEDSTYTQLWNWVPECLSCGSRC 100

101 SSDQVETQACTREQNRICTCRPGWYCALSKQEGCRLCAPLRKCRPGFGVA 150
    ||||||||||||||||||||||||||||||||||||||||||||||||||
101 SSDQVETQACTREQNRICTCRPGWYCALSKQEGCRLCAPLRKCRPGFGVA 150

Alignment of: HUMTNFRII_PEA_1_P18 (SEQ ID NO:860) x TR1B_HUMAN (SEQ ID NO:862) ..

```
  1 MAPVAVWAALAVGLELWAAAHALPAQVAFTPYAPEPGSTCRLREYYDQTA  50
    ||||||||||||||||||||||||||||||||||||||||||||||||||
  1 MAPVAVWAALAVGLELWAAAHALPAQVAFTPYAPEPGSTCRLREYYDQTA  50

51 QMCCSKCSPGQHAKVFCTKTSDTVCDSCEDSTYTQLWNWVPECLSCGSRC 100
    ||||||||||||||||||||||||||||||||||||||||||||||||||
 51 QMCCSKCSPGQHAKVFCTKTSDTVCDSCEDSTYTQLWNWVPECLSCGSRC 100

Alignment of: HUMTNFRII_PEA_1_P19 (SEQ ID NO:861) x TR1B_HUMAN (SEQ ID NO:862) ..

```
  1 MAPVAVWAALAVGLELWAAAHALPAQVAFTPYAPEPGSTCRLREYYDQTA  50
    ||||||||||||||||||||||||||||||||||||||||||||||||||
  1 MAPVAVWAALAVGLELWAAAHALPAQVAFTPYAPEPGSTCRLREYYDQTA  50

51 QMCCSKCSPGQHAKVFCTKTSDTVCDSCEDSTYTQLWNWVPECLSCGSRC 100
    ||||||||||||||||||||||||||||||||||||||||||||||||||
 51 QMCCSKCSPGQHAKVFCTKTSDTVCDSCEDSTYTQLWNWVPECLSCGSRC 100

101 SSDQVETQACTREQNRICTCRPGWYCALSKQEGCRLCAPLRKCRPGFGVA 150
    ||||||||||||||||||||||||||||||||||||||||||||||||||
101 SSDQVETQACTREQNRICTCRPGWYCALSKQEGCRLCAPLRKCRPGFGVA 150

151 RPGTETSDVVCKPCAPGTFSNTTSSTDICRPHQICNVVAIPGNASMDAVC 200
    ||||||||||||||||||||||||||||||||||||||||||||||||||
151 RPGTETSDVVCKPCAPGTFSNTTSSTDICRPHQICNVVAIPGNASMDAVC 200

201 TSTSPTRSMAPGAVHLPQPVSTRSQHTQPTPEPSTAPSTSFLLPMGPSPP 250
    ||||||||||||||||||||||||||||||||||||||||||||||||||
201 TSTSPTRSMAPGAVHLPQPVSTRSQHTQPTPEPSTAPSTSFLLPMGPSPP 250

251 AEGSTGDFALPV                                       262
    ||||||||||||
251 AEGSTGDFALPV                                       262
```

TNR3 – Lymphotoxin beta - Clinical

| Company | Candidate | Phase | Indications | Status and comments |
|---|---|---|---|---|
| Biogen-idec | soluble lymphotoxin-beta receptor | I | RA, Crohn's | No news since 1Q2002 |

Alignment of HUMTNFRRP_P2 (SEQ ID NO:898) x TNR3_HUMAN (SEQ ID NO:129) ..

```
  1 MLLPWATSAPGLAWGPLVLGLFGLLAASQPQAVPPYASENQTCRDQEKEY  50
    ||||||||||||||||||||||||||||||||||||||||||||||||||
  1 MLLPWATSAPGLAWGPLVLGLFGLLAASQPQAVPPYASENQTCRDQEKEY  50

51 YEPQHRICCSRCPPGTYVSAKCSRIRDTVCATCAENSYNEHWNYLTICQL 100
    ||||||||||||||||||||||||||||||||||||||||||||||||||
 51 YEPQHRICCSRCPPGTYVSAKCSRIRDTVCATCAENSYNEHWNYLTICQL 100

101 CRPCDPVMGLEEIAPCTSKRKTQCRCQPGMFCAAWALECTHCELLSDCPP 150
    ||||||||||||||||||||||||||||||||||||||||||||||||||
101 CRPCDPVMGLEEIAPCTSKRKTQCRCQPGMFCAAWALECTHCELLSDCPP 150

151 GTEAELK                                           157
    |||||||
151 GTEAELK                                           157
```

Figure 214

Alignment of HUMTNFRRP_P4 (SEQ ID NO:899) x TNR3_HUMAN (SEQ ID NO:129) ..

```
  1 MLLPWATSAPGLAWGPLVLGLFGLLAASQPQAVPPYASENQTCRDQEKEY  50
    ||||||||||||||||||||||||||||||||||||||||||||||||||
  1 MLLPWATSAPGLAWGPLVLGLFGLLAASQPQAVPPYASENQTCRDQEKEY  50

51 YEPQHRICCSRCPPGTYVSAKCSRIRDTVCATCAENSYNEHWNYLTICQL 100
    ||||||||||||||||||||||||||||||||||||||||||||||||||
 51 YEPQHRICCSRCPPGTYVSAKCSRIRDTVCATCAENSYNEHWNYLTICQL 100

101 CRPCDPVMGLEEIAPCTSKRKTQCRCQPGMFCAAWALECTHCELLSDCPP 150
    ||||||||||||||||||||||||||||||||||||||||||||||||||
101 CRPCDPVMGLEEIAPCTSKRKTQCRCQPGMFCAAWALECTHCELLSDCPP 150

151 GTEAELKDEVGKGNNHCVPCKAGHFQNTSSPSARCQPHTRCENQGLVEAA 200
    ||||||||||||||||||||||||||||||||||||||||||||||||||
151 GTEAELKDEVGKGNNHCVPCKAGHFQNTSSPSARCQPHTRCENQGLVEAA 200

201 PGTAQSDTTCKNPLEPLPPEMS                             222
    ||||||||||||||||||||||
201 PGTAQSDTTCKNPLEPLPPEMS                             222
```

Figure 215

Alignment of HUMTNFRRP_P9 (SEQ ID NO:900) x TNR3_HUMAN (SEQ ID NO:129) ..

```
  1 MLLPWATSAPGLAWGPLVLGLFGLLAASQPQAVPPYASENQTCRDQEKEY  50
    ||||||||||||||||||||||||||||||||||||||||||||||||||
  1 MLLPWATSAPGLAWGPLVLGLFGLLAASQPQAVPPYASENQTCRDQEKEY  50

51 YEPQHRICCSRCPPGTYVSAKCSRIRDTVCATCAENSYNEHWNYLTICQL 100
    ||||||||||||||||||||||||||||||||||||||||||||||||||
 51 YEPQHRICCSRCPPGTYVSAKCSRIRDTVCATCAENSYNEHWNYLTICQL 100

101 CRPCDPVMGLEEIAPCTSKRKTQCRCQPGMFCAAWALECTHCELLSDCPP 150
    ||||||||||||||||||||||||||||||||||||||||||||||||||
101 CRPCDPVMGLEEIAPCTSKRKTQCRCQPGMFCAAWALECTHCELLSDCPP 150

151 GTEAELK                                            157
    |||||||
151 GTEAELK                                            157
```

Figure 216

W.T 435    Sp | TNFR Cys rich | TNFR Cys rich | TNFR Cys rich | TNFR Cys rich | TM | Cytoplasmic
           1-30  42-81        82-124          125-168         169-211         228-248  249-435

P166       Sp | TNFR Cys rich | TNFR Cys rich | 10U                            exon 4 extension P255       Sp | TNFR Cys rich | TNFR Cys rich | TNFR Cys rich | 33U            New exon 7

P255       Sp | TNFR Cys rich | TNFR Cys rich | TNFR Cys rich | 24U            Skipping exon 5

IL-12 – Clinical Developments

| Company | Candidate | Phase | Indication | Status and comments |
|---|---|---|---|---|
| Abbott (thru Knoll) | ABT-874 J695 | III<br>II | RA<br>Crohn's, MS | fully-human anti-IL-12 MAb |
| Synta Pharmaceuticals | STA-5326 | II | Crohn's disease, rheumatoid arthritis (RA), psoriasis and multiple sclerosis (MS). | Oral |
| Abbott-Protein Design Labs | anti-IL-12 MAbs (SMART) | I | Autoimmune disease | |
| | | | | |

Alignment of: HUMCLMF35_PEA_1_PEA_2_P14 (SEQ ID NO:927) x
I12A_HUMAN (SEQ ID NO:933) ..

```
  1 MCPARSLLLVATLVLLDHLSLARNLPVATPDPGMFPCLHHSQNLLRAVSN  50
    |||||||||||||||||||||||||||||||||||||||||||||||||
  1 MCPARSLLLVATLVLLDHLSLARNLPVATPDPGMFPCLHHSQNLLRAVSN  50

51 MLQKARQTLEFYPCTSEEIDHEDITKDKTSTVEACLPLELTKNESCLNSR 100
    |||||||||||||||||||||||||||||||||||||||||||||||||
 51 MLQKARQTLEFYPCTSEEIDHEDITKDKTSTVEACLPLELTKNESCLNSR 100

101 ETSFIT                                            106
    ||||||
101 ETSFIT                                            106
```

FIGURE 219

Alignment of: HUMCLMF35_PEA_1_PEA_2_P15 (SEQ ID NO:928) x
I12A_HUMAN (SEQ ID NO:933)

```
  1 MCPARSLLLVATLVLLDHLSLARNLPVATPDPGMFPCLHHSQNLLRAVSN  50
    |||||||||||||||||||||||||||||||||||||||||||||||||
  1 MCPARSLLLVATLVLLDHLSLARNLPVATPDPGMFPCLHHSQNLLRAVSN  50

51 MLQKARQTLEFYPCTSEEIDHEDITKDKTSTVEACLPLELTK          92
    |||||||||||||||||||||||||||||||||||||||||
 51 MLQKARQTLEFYPCTSEEIDHEDITKDKTSTVEACLPLELTK          92
```

FIGURE 220

Alignment of: HUMCLMF35_PEA_1_PEA_2_P16 (SEQ ID NO:929) x
I12A_HUMAN (SEQ ID NO:933) ..

```
  1 MCPARSLLLVATLVLLDHLSLARNLPVATPDPGMFPCLHHSQNLLRAVSN  50
    |||||||||||||||||||||||||||||||||||||||||||||||||
  1 MCPARSLLLVATLVLLDHLSLARNLPVATPDPGMFPCLHHSQNLLRAVSN  50

51 MLQKARQTLEFYPCTSEEIDHEDITKDKTSTVEACLPLELTK........  92
    |||||||||||||||||||||||||||||||||||||||||
 51 MLQKARQTLEFYPCTSEEIDHEDITKDKTSTVEACLPLELTKNESCLNSR 100

93 ......NGSCLASRKTSFMMALCLSSIYEDLKMYQVEFKTMNAKLLMDPK 136
          |||||||||||||||||||||||||||||||||||||||||||
101 ETSFITNGSCLASRKTSFMMALCLSSIYEDLKMYQVEFKTMNAKLLMDPK 150

137 RQIFLDQNMLAVIDELMQALNFNSETVPQKSSLEEPDFYKTKIKLCILLH 186
    |||||||||||||||||||||||||||||||||||||||||||||||||
151 RQIFLDQNMLAVIDELMQALNFNSETVPQKSSLEEPDFYKTKIKLCILLH 200

187 AFRIRAVTIDRVMSYLNAS                               205
    |||||||||||||||||||
201 AFRIRAVTIDRVMSYLNAS                               219
```

FIGURE 221

Alignment of: HUMCLMF35_PEA_1_PEA_2_P17 (SEQ ID NO:930) x I12A_HUMAN (SEQ ID NO:933)

```
  1 MCPARSLLLVATLVLLDHLSLARNLPVATPDPGMFPCLHHSQNLLRAVSN  50
    ||||||||||||||||||||||||||||||||||||||||||||||||||
  1 MCPARSLLLVATLVLLDHLSLARNLPVATPDPGMFPCLHHSQNLLRAVSN  50

51 MLQ.........................KNESCLNSR  62
    |||                          |||||||||
 51 MLQKARQTLEFYPCTSEEIDHEDITKDKTSTVEACLPLELTKNESCLNSR 100

63 ETSFITNGSCLASRKTSFMMALCLSSIYEDLKMYQVEFKTMNAKLLMDPK 112
    ||||||||||||||||||||||||||||||||||||||||||||||||||
101 ETSFITNGSCLASRKTSFMMALCLSSIYEDLKMYQVEFKTMNAKLLMDPK 150

113 RQIFLDQNMLAVIDELMQALNFNSETVPQKSSLEEPDFYKTKIKLCILLH 162
    ||||||||||||||||||||||||||||||||||||||||||||||||||
151 RQIFLDQNMLAVIDELMQALNFNSETVPQKSSLEEPDFYKTKIKLCILLH 200

163 AFRIRAVTIDRVMSYLNAS                                181
    |||||||||||||||||||
201 AFRIRAVTIDRVMSYLNAS                                219
```

FIGURE 222

Alignment of: HUMCLMF35_PEA_1_PEA_2_P20 (SEQ ID NO:931) x I12A_HUMAN (SEQ ID NO:933)

```
  1 MCPARSLLLVATLVLLDHLSLARNLPVATPDPGMFPCLHHSQNLLRAVSN  50
    ||||||||||||||||||||||||||||||||||||||||||||||||||
  1 MCPARSLLLVATLVLLDHLSLARNLPVATPDPGMFPCLHHSQNLLRAVSN  50

51 MLQK..............................................  54
    ||||
 51 MLQKARQTLEFYPCTSEEIDHEDITKDKTSTVEACLPLELTKNESCLNSR 100

55 ....................ALCLSSIYEDLKMYQVEFKTMNAKLLMDPK  84
                        ||||||||||||||||||||||||||||||
101 ETSFITNGSCLASRKTSFMMALCLSSIYEDLKMYQVEFKTMNAKLLMDPK 150

85 RQIFLDQNMLAVIDELMQALNFNSETVPQKSSLEEPDFYKTKIKLCILLH 134
    ||||||||||||||||||||||||||||||||||||||||||||||||||
151 RQIFLDQNMLAVIDELMQALNFNSETVPQKSSLEEPDFYKTKIKLCILLH 200

135 AFRIRAVTIDRVMSYLNAS                                153
    |||||||||||||||||||
201 AFRIRAVTIDRVMSYLNAS                                219
```

FIGURE 223

Alignment of: HUMCLMF35_PEA_1_PEA_2_P22 (SEQ ID NO:932) x I12A_HUMAN (SEQ ID NO:933)

```
  1 MCPARSLLLVATLVLLDHLSLARNLPVATPDPGMFPCLHHSQNLLRAVSN  50
    |||||||||||||||||||||||||||||||||||||||||||||||||
  1 MCPARSLLLVATLVLLDHLSLARNLPVATPDPGMFPCLHHSQNLLRAVSN  50

51 MLQKARQTLEFYPCTSEEIDHEDITKDKTSTVEACLPLELTKNESCLNSR 100
    |||||||||||||||||||||||||||||||||||||||||||||||||
 51 MLQKARQTLEFYPCTSEEIDHEDITKDKTSTVEACLPLELTKNESCLNSR 100

101 ETSFITNGSCLASRKTSFMM.............................  120
    ||||||||||||||||||||
101 ETSFITNGSCLASRKTSFMMALCLSSIYEDLKMYQVEFKTMNAKLLMDPK 150

121 ...................ALNFNSETVPQKSSLEEPDFYKTKIKLCILLH 152
                       |||||||||||||||||||||||||||||||||
151 RQIFLDQNMLAVIDELMQALNFNSETVPQKSSLEEPDFYKTKIKLCILLH 200

153 AFRIRAVTIDRVMSYLNAS                               171
    |||||||||||||||||||
201 AFRIRAVTIDRVMSYLNAS                               219
```

Figure 22A

IL-12A Splice Variants

| Variant | Structure | Notes |
|---|---|---|
| W.T | S 1-22 / Helix A 43-58 / Helix B 118-145 / Helix C 155-169 / Helix D 190-217 | |
| P13 | S 1-22 / Helix A 43-58 / 59-116 / 240 | Intron 4 retention |
| P9 | S 1-22 / Helix A 43-58 / 59-93 | Intron 3-5 retention |
| P20 | S 1-22 / Helix A 43-58 / Helix B 118-145 / Helix C 155-169 / Helix D 190-217, Δ92-106 | Exon 4 skipping |
| P18 | S 1-22 / Helix A 43-58 / Helix B 118-145 / Helix C 155-169 / Helix D 190-217, Δ54-92 | Exon 3 skipping |
| P15 | S 1-22 / Helix A 43-58 / Helix B 118-145 / Helix C 155-169 / Helix D 190-217, Δ54-120 | Exon 3-5 skipping |
| P17 | S 1-22 / Helix A 43-58 / Helix D 190-217, Δ120-168 | Exon 6 skipping |

IL-6 – Clinical Developments

| Company | Candidate | Phase | Indication | Status and comments |
|---|---|---|---|---|
| Roche-Chugai | MRA Atlizumab Actemra | III | RA Crohn's, multiple myeloma, Castleman's disease. | |
| J&J (Centocor) | CNTO-328 human-mouse anti-IL-6 antibody | I | myeloma and cachexia | Int J Cancer. 2004 Sep 10;111(4):592-5. |
| Y's Therapeutics | YSII6 | II | RA (Psoriasis) | Small-molecule drug that inhibits TNF-alpha and IL-6 production in T-cells and macrophages. |

Alignment of: S56892_PEA_1_PEA_1_P8 (SEQ ID NO:956) x IL6_HUMAN (SEQ ID NO:959)

```
  1 MNSFSTSAFGPVAFSLGLLLVLPAAFPAPVPPGEDSKDVAAPHRQPLTSS  50
    ||||||||||||||||||||||||||||||||||||||||||||||||||
  1 MNSFSTSAFGPVAFSLGLLLVLPAAFPAPVPPGEDSKDVAAPHRQPLTSS  50

51 ERIDKQIRYILDGISALRKETCNKSNMCESSKEALAENNLNLPKMAEKDG 100
    ||||||||||||||||||||||||||||||||||||||||||||||||||
 51 ERIDKQIRYILDGISALRKETCNKSNMCESSKEALAENNLNLPKMAEKDG 100

101 CFQSGFNEETCLVKIITGLLEFEVYLEYLQNRFESSEEQARAVQMSTKVL 150
    ||||||||||||||||||||||||||||||||||||||||||||||||||
101 CFQSGFNEETCLVKIITGLLEFEVYLEYLQNRFESSEEQARAVQMSTKVL 150

151 IQFLQKK                                            157
    |||||||
151 IQFLQKK                                            157
```

Figure 228

Alignment of: S56892_PEA_1_PEA_1_P9 (SEQ ID NO:957) x IL6_HUMAN(SEQ ID NO:959)

```
  1 MNSFSTSAFGPVAFSLGLLLVLPAAFPAPVPPGEDSKDVAAPHRQPLTSS  50
    ||||||||||||||||||||||||||||||||||||||||||||||||||
  1 MNSFSTSAFGPVAFSLGLLLVLPAAFPAPVPPGEDSKDVAAPHRQPLTSS  50

51 ERIDKQIRYILDGISALRKETCNKSNMCESSKEALAENNLNLPKMAEKDG 100
    ||||||||||||||||||||||||||||||||||||||||||||||||||
 51 ERIDKQIRYILDGISALRKETCNKSNMCESSKEALAENNLNLPKMAEKDG 100

101 CFQSGFNE........................................ 108
    ||||||||
101 CFQSGFNEETCLVKIITGLLEFEVYLEYLQNRFESSEEQARAVQMSTKVL 150

109 .......AKNLDAITTPDPTTNASLLTKLQAQNQWLQDMTTHLILRSFKE 151
           |||||||||||||||||||||||||||||||||||||||||||
151 IQFLQKKAKNLDAITTPDPTTNASLLTKLQAQNQWLQDMTTHLILRSFKE 200

152 FLQSSLRALRQM                                      163
    ||||||||||||
201 FLQSSLRALRQM                                      212
```

Figure 229

Alignment of: S56892_PEA_1_PEA_1_P11 (SEQ ID NO:958) x IL6_HUMAN (SEQ ID NO: 959)

```
  1 MNSFSTSAFGPVAFSLGLLLVLPAAFPAPVPPGEDSKDVAAPHRQPLTSS 50
    ||||||||||||||||||||||||||||||||||||||||||||||||||
  1 MNSFSTSAFGPVAFSLGLLLVLPAAFPAPVPPGEDSKDVAAPHRQPLTSS 50

51 ERIDKQIRYILDGISALRKETCNKSNI                       77
    ||||||||||||||||||||||||||:
 51 ERIDKQIRYILDGISALRKETCNKSNM                       77
```

Figure 230

Alignment of: HUMTGFBIIR_PEA_1_P9 (SEQ ID NO:972) x TGR2_HUMAN (SEQ ID NO:974)

```
  1 MGRGLLRGLWPLHIVLWTRIASTIPPHVQKSVNNDMIVTDNNGAVKFPQL 50
    |||||||||||||||||||||||||||||||||||||||||||||||||
  1 MGRGLLRGLWPLHIVLWTRIASTIPPHVQKSVNNDMIVTDNNGAVKFPQL 50

51 CKFCDVRFSTCDNQKSCMSNCSITSICEKPQEVCVAVWRKNDENITLETV 100
    |||||||||||||||||||||||||||||||||||||||||||||||||
 51 CKFCDVRFSTCDNQKSCMSNCSITSICEKPQEVCVAVWRKNDENITLETV 100

101 CHDPKLPYHDFILEDAASPKCIMKEKKKPGETFFMCSCSSDECNDNIIFS 150
    |||||||||||||||||||||||||||||||||||||||||||||||||
101 CHDPKLPYHDFILEDAASPKCIMKEKKKPGETFFMCSCSSDECNDNIIFS 150

Alignment of: HUMTGFBIIR_PEA_1_P14 (SEQ ID NO:973) x TGR2_HUMAN (SEQ ID NO:974)

```
  1 MGRGLLRGLWPLHIVLWTRIASTIPPHVQKSVNNDMIVTDNNGAVKFPQL 50
    |||||||||||||||||||||||||||||||||||||||||||||||||
  1 MGRGLLRGLWPLHIVLWTRIASTIPPHVQKSVNNDMIVTDNNGAVKFPQL 50

51 CKFCDVRFSTCDNQKSCMSNCSITSICEKPQEVCVAVWRKNDENITLETV 100
    |||||||||||||||||||||||||||||||||||||||||||||||||
 51 CKFCDVRFSTCDNQKSCMSNCSITSICEKPQEVCVAVWRKNDENITLETV 100

101 CHDPKLPYHDFILEDAASPKCIMKEKKKPGETFFMCSCSSDECNDNIIFS 150
    |||||||||||||||||||||||||||||||||||||||||||||||||
101 CHDPKLPYHDFILEDAASPKCIMKEKKKPGETFFMCSCSSDECNDNIIFS 150

151 EDF                                               153
    |::
151 EEY                                               153
```

Figure 232

W.T 567: SP (1-23) | TGFaR/activinR (77-147) | TM (167-181) | Protein kinase (244-538)

P156: SP (1-23) | TGFaR/activinR (77-147) | 5U — New exon 4

P156: SP (1-23) | TGFaR/activinR (77-147) | 24U — exon 3 extention

GCSF – Launched Products

| Company | Product | Indication | Status and comments |
|---|---|---|---|
| Amgen | Neulasta® GCSF (PEGfilgrastim) | Chemotherapy induced neutropenia | 2003 sales: $1.265Bn |
| Amgen | NEUPOGEN® filgrastim | | 2003 sales: $1.267Bn Promotion terminated. |
| Roche | Neupogen* filgrastim | | 2002 sales: $289 million |
| Sankyo | Gran filgrastim | | 2002 sales: $113 million |
| Chugai-Aventis | Neutrogin/Granocyte lenograstim | | 2002 sales: $162 million |
| Kyowa H | NEU-UP nartograstim | | 2002 sales: $40 million |
| DongA | GCSF | | |

Fig. 233

GCSF – Clinical Developments

| Company | Candidate | Phase | Indication | Status and comments |
|---|---|---|---|---|
| Transkaryotic (TKT) | GA-GCSF | I | chemotherapy-induced neutropenia | Completed phase I<br>Gene activation production technology® cost advantage |
| Dragon Biotech | GCSF | ? | | Licensed from Zhongkai, Chinese producer with GCSF approved in China (production in E.Coli, compete on cost) |
| | | | | |

Fig. 234

GCSF – PreClinical Developments

| Company | Candidate | Indication | Status and comments |
|---|---|---|---|
| Maxygen | Maxy996 | chemotherapy-induced neutropenia | novel G-CSF that further reduces the duration of neutropenia while maintaining the once-weekly dosing |
| Neose | PEGylated GCSF | | IND expected in mid-2005 |
| HGS | Albumin-fused GCSD Albugranin | | On hold or discontinued |
| Ethypharm | Controlled release GCSF | | |
| Affymax | GCSF-R agnoist peptides | Rhinitis (?), asthma (?) | Early preclinical |

| | W.T 204 | P151 | P107 | P187 | P147 | P168 | P103 |
|---|---|---|---|---|---|---|---|
| SP | SP 1-22 | SP | SP | SP | 9U SP | SP | 9U SP |
| Helix I | Helix I 43-68 | Helix I | Helix I | Helix I | Helix I | Helix I | Helix I |
| Helix II | Helix II 103-123 | Helix II | 6U | Helix II | Helix II | Helix II | 6U |
| Helix III | Helix III 132-155 | Helix III | | Helix III | Helix III | Helix III | |
| | Helix IV 175-204 | 37U | | 37U | 37U | Helix IV | |

Figure 237

Alignment of: HUMGCSF_PEA_1_P5 (SEQ ID NO:1000) x CSF3_HUMAN (SEQ ID NO:128) ..

```
  1 MAGPATQSPMKLMALQLLLWHSALWTVQEATPLGPASSLPQSFLLKCLEQ  50
    ||||||||||||||||||||||||||||||||||||||||||||||||||
  1 MAGPATQSPMKLMALQLLLWHSALWTVQEATPLGPASSLPQSFLLKCLEQ  50

51 VRKIQGDGAALQEK....................................  64
    ||||||||||||||
 51 VRKIQGDGAALQEKLVSECATYKLCHPEELVLLGHSLGIPWAPLSSCPSQ 100

65 ...LAGCLSQLHSGLFLYQGLLQALEGISPELGPTLDTLQLDVADFATTI 111
       |||||||||||||||||||||||||||||||||||||||||||||||
101 ALQLAGCLSQLHSGLFLYQGLLQALEGISPELGPTLDTLQLDVADFATTI 150

112 WQQ                                                114
    |||
151 WQQ                                                153
```

Figure 238

Alignment of: HUMGCSF_PEA_1_P6 (SEQ ID NO:1001) x CSF3_HUMAN (SEQ ID NO:128) ..

```
  1 MAGPATQSPMKLMALQLLLWHSALWTVQEATPLGPASSLPQSFLLKCLEQ  50
    ||||||||||||||||||||||||||||||||||||||||||||||||||
  1 MAGPATQSPMKLMALQLLLWHSALWTVQEATPLGPASSLPQSFLLKCLEQ  50

51 VRKIQGDGAALQEKLVSECATYKLCHPEELVLLGHSLGIPWAPLSSCPSQ 100
    ||||||||||||||||||||||||||||||||||||||||||||||||||
 51 VRKIQGDGAALQEKLVSECATYKLCHPEELVLLGHSLGIPWAPLSSCPSQ 100

101 ALQL                                               104
    ||||
101 ALQL                                               104
```

Figure 239

Alignment of: HUMGCSF_PEA_1_P7 (SEQ ID NO:1002) x CSF3_HUMAN (SEQ ID NO:128) ..

```
  1 MAGPATQSPMKLMALQLLLWHSALWTVQEATPLGPASSLPQSFLLKCLEQ  50
    ||||||||||||||||||||||||||||||||||||||||||||||||||
  1 MAGPATQSPMKLMALQLLLWHSALWTVQEATPLGPASSLPQSFLLKCLEQ  50

51 VRKIQGDGAALQEKLVSECATYKLCHPEELVLLGHSLGIPWAPLSSCPSQ 100
    ||||||||||||||||||||||||||||||||||||||||||||||||||
 51 VRKIQGDGAALQEKLVSECATYKLCHPEELVLLGHSLGIPWAPLSSCPSQ 100

101 ALQLAGCLSQLHSGLFLYQGLLQALEGISPELGPTLDTLQLDVADFATTI 150
    ||||||||||||||||||||||||||||||||||||||||||||||||||
101 ALQLAGCLSQLHSGLFLYQGLLQALEGISPELGPTLDTLQLDVADFATTI 150

151 WQQ                                                153
    |||
151 WQQ                                                153
```

Figure 240

Alignment of: HUMGCSF_PEA_1_P8 (SEQ ID NO:1003) x CSF3_HUMAN (SEQ ID NO:128) ..

```
 10 ALQLLLWHSALWTVQEATPLGPASSLPQSFLLKCLEQVRKIQGDGAALQE  59
    ||||||||||||||||||||||||||||||||||||||||||||||||||
 14 ALQLLLWHSALWTVQEATPLGPASSLPQSFLLKCLEQVRKIQGDGAALQE  63

60 K.........................................LAGCLSQLHS  70
    |                                          |||||||||
 64 KLVSECATYKLCHPEELVLLGHSLGIPWAPLSSCPSQALQLAGCLSQLHS 113

71 GLFLYQGLLQALEGISPELGPTLDTLQLDVADFATTIWQQ            110
    |||||||||||||||||||||||||||||||||||||||
114 GLFLYQGLLQALEGISPELGPTLDTLQLDVADFATTIWQQ            153
```

Figure 241

Alignment of: HUMGCSF_PEA_1_P8 (SEQ ID NO:1003) x Q8N4W3 (SEQ ID NO:1012)

```
  1 MSPEPALSPALQLLLWHSALWTVQEATPLGPASSLPQSFLLKCLEQVRKI  50
    ||||||||||||||||||||||||||||||||||||||||||||||||||
  1 MSPEPALSPALQLLLWHSALWTVQEATPLGPASSLPQSFLLKCLEQVRKI  50

51 QGDGAALQEK..................................LAGC  64
    ||||||||||                                   ||||
 51 QGDGAALQEKLCATYKLCHPEELVLLGHSLGIPWAPLSSCPSQALQLAGC 100

65 LSQLHSGLFLYQGLLQALEGISPELGPTLDTLQLDVADFATTIWQQ    110
    |||||||||||||||||||||||||||||||||||||||||||||
101 LSQLHSGLFLYQGLLQALEGISPELGPTLDTLQLDVADFATTIWQQ    146
```

Figure 242

Alignment of: HUMGCSF_PEA_1_P9 (SEQ ID NO:1004) x CSF3_HUMAN (SEQ ID NO:128)

```
  1 MAGPATQSPMKLMALQLLLWHSALWTVQEATPLGPASSLPQSFLLKCLEQ  50
    ||||||||||||||||||||||||||||||||||||||||||||||||||
  1 MAGPATQSPMKLMALQLLLWHSALWTVQEATPLGPASSLPQSFLLKCLEQ  50

51 VRKIQGDGAALQEK..................................  64
    ||||||||||||||
 51 VRKIQGDGAALQEKLVSECATYKLCHPEELVLLGHSLGIPWAPLSSCPSQ 100

65 ...LAGCLSQLHSGLFLYQGLLQALEGISPELGPTLDTLQLDVADFATTI 111
       |||||||||||||||||||||||||||||||||||||||||||||||
101 ALQLAGCLSQLHSGLFLYQGLLQALEGISPELGPTLDTLQLDVADFATTI 150

112 WQQMEELGMAPALQPTQGAMPAFASAFQRRAGGVLVASHLQSFLEVSYRV 161
    ||||||||||||||||||||||||||||||||||||||||||||||||||
151 WQQMEELGMAPALQPTQGAMPAFASAFQRRAGGVLVASHLQSFLEVSYRV 200

162 LRHLAQP                                           168
    |||||||
201 LRHLAQP                                           207
```

Figure 243

Alignment of: HUMGCSF_PEA_1_P13 (SEQ ID NO:1005) x CSF3_HUMAN (SEQ ID NO:128)

```
  1 MAGPATQSPMKLMALQLLLWHSALWTVQEATPLGPASSLPQSFLLKCLEQ  50
    ||||||||||||||||||||||||||||||||||||||||||||||||||
  1 MAGPATQSPMKLMALQLLLWHSALWTVQEATPLGPASSLPQSFLLKCLEQ  50

51 VRKIQGDGAALQEKLVSE................................  68
    ||||||||||||||||||
 51 VRKIQGDGAALQEKLVSECATYKLCHPEELVLLGHSLGIPWAPLSSCPSQ 100

69 ....AGCLSQLHSGLFLYQGLLQALEGISPELGPTLDTLQLDVADFATTI 114
        ||||||||||||||||||||||||||||||||||||||||||||||
101 ALQLAGCLSQLHSGLFLYQGLLQALEGISPELGPTLDTLQLDVADFATTI 150

115 WQQMEELGMAPALQPTQGAMPAFASAFQRRAGGVLVASHLQSFLEVSYRV 164
    ||||||||||||||||||||||||||||||||||||||||||||||||||
151 WQQMEELGMAPALQPTQGAMPAFASAFQRRAGGVLVASHLQSFLEVSYRV 200

165 LRHLAQP                                            171
    |||||||
201 LRHLAQP                                            207
```

Figure 244

Alignment of: HUMGCSF_PEA_1_P14 (SEQ ID NO:1006) x CSF3_HUMAN (SEQ ID NO:128)

```
 10 ALQLLLWHSALWTVQEATPLGPASSLPQSFLLKCLEQVRKIQGDGAALQE  59
    ||||||||||||||||||||||||||||||||||||||||||||||||||
 14 ALQLLLWHSALWTVQEATPLGPASSLPQSFLLKCLEQVRKIQGDGAALQE  63

60 KL...CATYKLCHPEELVLLGHSLGIPWAPLSSCPSQALQL           97
    ||   |||||||||||||||||||||||||||||||||||
 64 KLVSECATYKLCHPEELVLLGHSLGIPWAPLSSCPSQALQL          104
```

Figure 245

Alignment of: HUMGCSF_PEA_1_P14 (SEQ ID NO:1006) x Q8N4W3 (SEQ ID NO:1012)

```
  1 MSPEPALSPALQLLLWHSALWTVQEATPLGPASSLPQSFLLKCLEQVRKI  50
    ||||||||||||||||||||||||||||||||||||||||||||||||||
  1 MSPEPALSPALQLLLWHSALWTVQEATPLGPASSLPQSFLLKCLEQVRKI  50

51 QGDGAALQEKLCATYKLCHPEELVLLGHSLGIPWAPLSSCPSQALQL     97
    ||||||||||||||||||||||||||||||||||||||||||||||
 51 QGDGAALQEKLCATYKLCHPEELVLLGHSLGIPWAPLSSCPSQALQL     97
```

Figure 246

Alignment of: HUMGCSF_PEA_1_P16 (SEQ ID NO:1007) x CSF3_HUMAN (SEQ ID NO:128)

```
  1 MAGPATQSPMKLMALQLLLWHSALWTVQEATPLGPASSLPQSFLLKCLEQ  50
    ||||||||||||||||||||||||||||||||||||||||||||||||||
  1 MAGPATQSPMKLMALQLLLWHSALWTVQEATPLGPASSLPQSFLLKCLEQ  50

51 VRKIQGDGAALQEKLVSE................................  68
    ||||||||||||||||||
 51 VRKIQGDGAALQEKLVSECATYKLCHPEELVLLGHSLGIPWAPLSSCPSQ 100

69 ....AGCLSQLHSGLFLYQGLLQALEGISPELGPTLDTLQLDVADFATTI 114
        ||||||||||||||||||||||||||||||||||||||||||||||
101 ALQLAGCLSQLHSGLFLYQGLLQALEGISPELGPTLDTLQLDVADFATTI 150

115 WQQ                                                117
    |||
151 WQQ                                                153
```

Figure 247

Alignment of: HUMGCSF_PEA_1_P18 (SEQ ID NO:1008) x CSF3_HUMAN (SEQ ID NO:128)

```
  1 MAGPATQSPMKLMALQLLLWHSALWTVQEATPLGPASSLPQSFLLKCLEQ  50
    ||||||||||||||||||||||||||||||||||||||||||||||||||
  1 MAGPATQSPMKLMALQLLLWHSALWTVQEATPLGPASSLPQSFLLKCLEQ  50

51 VRKIQGDGAALQEKL...CATYKLCHPEELVLLGHSLGIPWAPLSSCPSQ  97
    |||||||||||||||   ||||||||||||||||||||||||||||||||
 51 VRKIQGDGAALQEKLVSECATYKLCHPEELVLLGHSLGIPWAPLSSCPSQ 100

98 ALQLAGCLSQLHSGLFLYQGLLQALEGISPELGPTLDTLQLDVADFATTI 147
    ||||||||||||||||||||||||||||||||||||||||||||||||||
101 ALQLAGCLSQLHSGLFLYQGLLQALEGISPELGPTLDTLQLDVADFATTI 150

148 WQQ                                                150
    |||
151 WQQ                                                153
```

Figure 248

Alignment of: HUMGCSF_PEA_1_P19 (SEQ ID NO:1009) x CSF3_HUMAN (SEQ ID NO:128)

```
 10 ALQLLLWHSALWTVQEATPLGPASSLPQSFLLKCLEQVRKIQGDGAALQE  59
    ||||||||||||||||||||||||||||||||||||||||||||||||||
 14 ALQLLLWHSALWTVQEATPLGPASSLPQSFLLKCLEQVRKIQGDGAALQE  63

60 KLVSE.............................AGCLSQLHS  73
    |||||                              ||||||||||
 64 KLVSECATYKLCHPEELVLLGHSLGIPWAPLSSCPSQALQLAGCLSQLHS 113

74 GLFLYQGLLQALEGISPELGPTLDTLQLDVADFATTIWQQ           113
    |||||||||||||||||||||||||||||||||||||||
114 GLFLYQGLLQALEGISPELGPTLDTLQLDVADFATTIWQQ           153
```

Figure 249

Alignment of: HUMGCSF_PEA_1_P20 (SEQ ID NO:1010) x CSF3_HUMAN (SEQ ID NO:128)

```
 10 ALQLLLWHSALWTVQEATPLGPASSLPQSFLLKCLEQVRKIQGDGAALQE  59
    ||||||||||||||||||||||||||||||||||||||||||||||||||
 14 ALQLLLWHSALWTVQEATPLGPASSLPQSFLLKCLEQVRKIQGDGAALQE  63

60 KLVSECATYKLCHPEELVLLGHSLGIPWAPLSSCPSQALQL           100
    ||||||||||||||||||||||||||||||||||||||||
 64 KLVSECATYKLCHPEELVLLGHSLGIPWAPLSSCPSQALQL           104
```

Figure 250

Alignment of: HUMGCSF_PEA_1_P20 (SEQ ID NO:1010) x Q8N4W3 (SEQ ID NO:1012)

```
  1 MSPEPALSPALQLLLWHSALWTVQEATPLGPASSLPQSFLLKCLEQVRKI  50
    ||||||||||||||||||||||||||||||||||||||||||||||||||
  1 MSPEPALSPALQLLLWHSALWTVQEATPLGPASSLPQSFLLKCLEQVRKI  50

51 QGDGAALQEKLVSECATYKLCHPEELVLLGHSLGIPWAPLSSCPSQALQL 100
    |||||||||||   ||||||||||||||||||||||||||||||||||||
 51 QGDGAALQEKL...CATYKLCHPEELVLLGHSLGIPWAPLSSCPSQALQL  97
```

Figure 251

Alignment of: HUMGCSF_PEA_1_P21 (SEQ ID NO:1011) x CSF3_HUMAN (SEQ ID NO:128)

```
  1 MAGPATQSPMKLMALQLLLWHSALWTVQEATPLGPASSLPQSFLLKCLEQ  50
    ||||||||||||||||||||||||||||||||||||||||||||||||||
  1 MAGPATQSPMKLMALQLLLWHSALWTVQEATPLGPASSLPQSFLLKCLEQ  50

51 VRKIQGDGAALQEKL...CATYKLCHPEELVLLGHSLGIPWAPLSSCPSQ  97
    |||||||||||||||   ||||||||||||||||||||||||||||||||
 51 VRKIQGDGAALQEKLVSECATYKLCHPEELVLLGHSLGIPWAPLSSCPSQ 100

98 ALQL                                               101
    ||||
101 ALQL                                               104
```

TGF beta - Clinical

| Company | Candidate | Phase | Indication | Status and comments |
|---|---|---|---|---|
| CAT | Trabio = Lerdelimu mab = CAT 152 | II/III | Glaucoma surgery scarring | Preliminary efficacy results negative; awaiting final results, may be terminated |
| CAT-Genzyme | CAT-192 Metelimum ab | I/II | diffuse systemic sclerosis | Safety OK; efficacy ambiguous; continuation pending definition |
| Antisense Pharma | AP 12009 Antisense for TGF beta 2 | II / I | malignant glioma Pancreatic cancer | In process |
| Fibrogen | FG-3019 Anti-CTGF mAb | II | fibrotic disease, diabetic complications, cancer | In process |

Fig. 252

TGF beta – Pre-clinical

| Company | Candidate | Indication | Status and comments |
|---|---|---|---|
| CAT-Genzyme | GC-1008 | idiopathic pulmonary fibrosis; cancers | Completed additional preclinical study requested by FDA; phase I to start 2005 |
| Biogen-Idec | | Fibrosis | Soluble TGF-receptor beta 2; mAbs? (specific to type 1?) |
| Genentech | Anti-TGFbeta mAbs | Cancer | Preclinical |
| J&J (Scios) | Oral TGFbeta R antagonists | COPD (Chronic Obstructive Pulmonary Disease) | Preclinical |
| GSK | SB-431542 | malignant gliomas | preclinical |
| Fibrogen | Anti-TGF beta | fibrotic disease, diabetes, cancer | preclinical |
| Eli Lilly | LY-364947 Specific for type 1 | Cancer | Preclinical |

| | | | |
|---|---|---|---|
| W.T 390 | SP 1-29 | Propeptide LAP 30-278 | TGF-beta 279-390 |
| P248 | SP 1-29 | Propeptide LAP 30-238 | 10U | Intron 4 retention |
| P357 | SP 1-29 | Propeptide LAP 30-278 | TGF-beta 279-338 | 21U | New exon 7 |
| P332 | SP 1-29 | Propeptide LAP 30-237 | 95U | Exon 5 skipping |
| P370 | SP 1-29 | Propeptide LAP 30-236 | 80U | TGF-beta 338-390 | Exon 5 skipping + exon 6 extension |

Figure 255

Alignment of: HSTGFB1_PEA_1_P2 (SEQ ID NO:1043) x TGF1_HUMAN (SEQ ID NO:1048)

```
  1 MPPSGLRLLLLLLPLLWLLVLTPGRPAAGLSTCKTIDMELVKRKRIEAIR  50
    ||||||||||||||||||||||||||||||||||||||||||||||||||
  1 MPPSGLRLLLLLLPLLWLLVLTPGRPAAGLSTCKTIDMELVKRKRIEAIR  50

51 GQILSKLRLASPPSQGEVPPGPLPEAVLALYNSTRDRVAGESAEPEPEPE 100
    ||||||||||||||||||||||||||||||||||||||||||||||||||
 51 GQILSKLRLASPPSQGEVPPGPLPEAVLALYNSTRDRVAGESAEPEPEPE 100

101 ADYYAKEVTRVLMVETHNEIYDKFKQSTHSIYMFFNTSELREAVPEPVLL 150
    ||||||||||||||||||||||||||||||||||||||||||||||||||
101 ADYYAKEVTRVLMVETHNEIYDKFKQSTHSIYMFFNTSELREAVPEPVLL 150

151 SRAELRLLRLKLKVEQHVELYQKYSNNSWRYLSNRLLAPSDSPEWLSFDV 200
    ||||||||||||||||||||||||||||||||||||||||||||||||||
151 SRAELRLLRLKLKVEQHVELYQKYSNNSWRYLSNRLLAPSDSPEWLSFDV 200

201 TGVVRQWLSRGGEIEGFRLSAHCSCDSRDNTLQVDING             238
    |||||||||||||||||||||||||||||||||||||
201 TGVVRQWLSRGGEIEGFRLSAHCSCDSRDNTLQVDING             238
```

Figure 256

Alignment of: HSTGFB1_PEA_1_P3 (SEQ ID NO:1044) x TGF1_HUMAN (SEQ ID NO:1048)

```
  1 MPPSGLRLLLLLLPLLWLLVLTPGRPAAGLSTCKTIDMELVKRKRIEAIR  50
    ||||||||||||||||||||||||||||||||||||||||||||||||||
  1 MPPSGLRLLLLLLPLLWLLVLTPGRPAAGLSTCKTIDMELVKRKRIEAIR  50

51 GQILSKLRLASPPSQGEVPPGPLPEAVLALYNSTRDRVAGESAEPEPEPE 100
    ||||||||||||||||||||||||||||||||||||||||||||||||||
 51 GQILSKLRLASPPSQGEVPPGPLPEAVLALYNSTRDRVAGESAEPEPEPE 100

101 ADYYAKEVTRVLMVETHNEIYDKFKQSTHSIYMFFNTSELREAVPEPVLL 150
    ||||||||||||||||||||||||||||||||||||||||||||||||||
101 ADYYAKEVTRVLMVETHNEIYDKFKQSTHSIYMFFNTSELREAVPEPVLL 150

151 SRAELRLLRLKLKVEQHVELYQKYSNNSWRYLSNRLLAPSDSPEWLSFDV 200
    ||||||||||||||||||||||||||||||||||||||||||||||||||
151 SRAELRLLRLKLKVEQHVELYQKYSNNSWRYLSNRLLAPSDSPEWLSFDV 200

201 TGVVRQWLSRGGEIEGFRLSAHCSCDSRDNTLQVDINGFTTGRRGDLATI 250
    ||||||||||||||||||||||||||||||||||||||||||||||||||
201 TGVVRQWLSRGGEIEGFRLSAHCSCDSRDNTLQVDINGFTTGRRGDLATI 250

251 HGMNRPFLLLMATPLERAQHLQSSRHRRALDTNYCFSSTEKNCCVRQLYI 300
    ||||||||||||||||||||||||||||||||||||||||||||||||||
251 HGMNRPFLLLMATPLERAQHLQSSRHRRALDTNYCFSSTEKNCCVRQLYI 300

301 DFRKDLGWKWIHEPKGYHANFCLGPCPYIWSLDTQYSKV            339
    ||||||||||||||||||||||||||||||||||||||
301 DFRKDLGWKWIHEPKGYHANFCLGPCPYIWSLDTQYSKV            339
```

Figure 257

Alignment of: HSTGFB1_PEA_1_P5 (SEQ ID NO:1045) x TGF1_HUMAN (SEQ ID NO:1048)

```
  1 MPPSGLRLLLLLLLPLLWLLVLTPGRPAAGLSTCKTIDMELVKRKRIEAIR  50
    ||||||||||||||||||||||||||||||||||||||||||||||||||
  1 MPPSGLRLLLLLLLPLLWLLVLTPGRPAAGLSTCKTIDMELVKRKRIEAIR  50

51 GQILSKLRLASPPSQGEVPPGPLPEAVLALYNSTRDRVAGESAEPEPEPE  100
    ||||||||||||||||||||||||||||||||||||||||||||||||||
 51 GQILSKLRLASPPSQGEVPPGPLPEAVLALYNSTRDRVAGESAEPEPEPE  100

101 ADYYAKEVTRVLMVETHNEIYDKFKQSTHSIYMFFNTSELREAVPEPVLL  150
    ||||||||||||||||||||||||||||||||||||||||||||||||||
101 ADYYAKEVTRVLMVETHNEIYDKFKQSTHSIYMFFNTSELREAVPEPVLL  150

151 SRAELRLLRLKLKVEQHVELYQKYSNNSWRYLSNRLLAPSDSPEWLSFDV  200
    ||||||||||||||||||||||||||||||||||||||||||||||||||
151 SRAELRLLRLKLKVEQHVELYQKYSNNSWRYLSNRLLAPSDSPEWLSFDV  200

201 TGVVRQWLSRGGEIEGFRLSAHCSCDSRDNTLQVDINGFTTGRRGDLATI  250
    ||||||||||||||||||||||||||||||||||||||||||||||||||
201 TGVVRQWLSRGGEIEGFRLSAHCSCDSRDNTLQVDINGFTTGRRGDLATI  250

251 HGMNRPFLLLMATPLERAQHLQSSRHRRALDTNYCFSSTEKNCCVRQLYI  300
    ||||||||||||||||||||||||||||||||||||||||||||||||||
251 HGMNRPFLLLMATPLERAQHLQSSRHRRALDTNYCFSSTEKNCCVRQLYI  300

301 DFRKDLGWKWIHEPKGYHANFCLGPCPYIWSLDTQYSK              338
    |||||||||||||||||||||||||||||||||||||
301 DFRKDLGWKWIHEPKGYHANFCLGPCPYIWSLDTQYSK              338
```

Figure 258

Alignment of: HSTGFB1_PEA_1_P7 (SEQ ID NO:1046) x TGF1_HUMAN (SEQ ID NO:1048)

```
  1 MPPSGLRLLLLLLPLLWLLVLTPGRPAAGLSTCKTIDMELVKRKRIEAIR  50
    ||||||||||||||||||||||||||||||||||||||||||||||||||
  1 MPPSGLRLLLLLLPLLWLLVLTPGRPAAGLSTCKTIDMELVKRKRIEAIR  50

51 GQILSKLRLASPPSQGEVPPGPLPEAVLALYNSTRDRVAGESAEPEPEPE 100
    ||||||||||||||||||||||||||||||||||||||||||||||||||
 51 GQILSKLRLASPPSQGEVPPGPLPEAVLALYNSTRDRVAGESAEPEPEPE 100

101 ADYYAKEVTRVLMVETHNEIYDKFKQSTHSIYMFFNTSELREAVPEPVLL 150
    ||||||||||||||||||||||||||||||||||||||||||||||||||
101 ADYYAKEVTRVLMVETHNEIYDKFKQSTHSIYMFFNTSELREAVPEPVLL 150

151 SRAELRLLRLKLKVEQHVELYQKYSNNSWRYLSNRLLAPSDSPEWLSFDV 200
    ||||||||||||||||||||||||||||||||||||||||||||||||||
151 SRAELRLLRLKLKVEQHVELYQKYSNNSWRYLSNRLLAPSDSPEWLSFDV 200

201 TGVVRQWLSRGGEIEGFRLSAHCSCDSRDNTLQVDIN              237
    |||||||||||||||||||||||||||||||||||||
201 TGVVRQWLSRGGEIEGFRLSAHCSCDSRDNTLQVDIN              237
```

Figure 259

Alignment of: HSTGFB1_PEA_1_P10 (SEQ ID NO:1047) x TGF1_HUMAN (SEQ ID NO:1048)

```
  1 MPPSGLRLLLLLLPLLWLLVLTPGRPAAGLSTCKTIDMELVKRKRIEAIR  50
    ||||||||||||||||||||||||||||||||||||||||||||||||||
  1 MPPSGLRLLLLLLPLLWLLVLTPGRPAAGLSTCKTIDMELVKRKRIEAIR  50

51 GQILSKLRLASPPSQGEVPPGPLPEAVLALYNSTRDRVAGESAEPEPEPE 100
    ||||||||||||||||||||||||||||||||||||||||||||||||||
 51 GQILSKLRLASPPSQGEVPPGPLPEAVLALYNSTRDRVAGESAEPEPEPE 100

101 ADYYAKEVTRVLMVETHNEIYDKFKQSTHSIYMFFNTSELREAVPEPVLL 150
    ||||||||||||||||||||||||||||||||||||||||||||||||||
101 ADYYAKEVTRVLMVETHNEIYDKFKQSTHSIYMFFNTSELREAVPEPVLL 150

151 SRAELRLLRLKLKVEQHVELYQKYSNNSWRYLSNRLLAPSDSPEWLSFDV 200
    ||||||||||||||||||||||||||||||||||||||||||||||||||
151 SRAELRLLRLKLKVEQHVELYQKYSNNSWRYLSNRLLAPSDSPEWLSFDV 200

201 TGVVRQWLSRGGEIEGFRLSAHCSCDSRDNTLQVDIN.............  237
    ||||||||||||||||||||||||||||||||||||
201 TGVVRQWLSRGGEIEGFRLSAHCSCDSRDNTLQVDINGFTTGRRGDLATI 250

237 ..................................................  237

251 HGMNRPFLLLMATPLERAQHLQSSRHRRALDTNYCFSSTEKNCCVRQLYI 300

238 ............................................APRRRTAACG 247
                                                        |
301 DFRKDLGWKWIHEPKGYHANFCLGPCPYIWSLDTQYSKVLA.........  341

248 SCTLTSARTSAGSGSTSPRATMPTSASGPAPTFGAWTRSTARYVWPTGLR 297

341 ..................................................  341

298 DALGGSQDGGRGERKRSKVREVLALYNQHNPGASAAPCCVPQALEPLPIV 347
                              |||||||||||||||||||||||||||
342 .......................LYNQHNPGASAAPCCVPQALEPLPIV 367

348 YVVGRKPKVEQLSNMIVRSCKCS                             370
    |||||||||||||||||||||||
368 YVVGRKPKVEQLSNMIVRSCKCS                             390
```

Figure 260

Alignment of: HUMUPAA_P14 (SEQ ID NO:1102) x TPA_HUMAN (SEQ ID NO:150)

```
  1 MDAMKRGLCCVLLLCGAVFVSPSQEIHARFRRGARSYQVICRDEKTQMIY  50
    ||||||||||||||||||||||||||||||||||||||||||||||||||
  1 MDAMKRGLCCVLLLCGAVFVSPSQEIHARFRRGARSYQVICRDEKTQMIY  50

51 QQHH..............................................  54
    |||:
 51 QQHQSWLRPVLRSNRVEYCWCNSGRAQCHSVPVKSCSEPRCFNGGTCQQA 100

55 ................................YRGTWSTAESGAECTN  70
                                     |||||||||||||||||
101 LYFSDFVCQCPEGFAGKCCEIDTRATCYEDQGISYRGTWSTAESGAECTN 150

71 WNSSALAQKPYSGRRPDAIRLGLGNHNYCRNPDRDSKPWCYVFKAGKYSS 120
    ||||||||||||||||||||||||||||||||||||||||||||||||||
151 WNSSALAQKPYSGRRPDAIRLGLGNHNYCRNPDRDSKPWCYVFKAGKYSS 200

121 EFCSTPACSEGNSDCYFGNGSAYRGTHSLTESGASCLPWNSMILIGKVYT 170
    ||||||||||||||||||||||||||||||||||||||||||||||||||
201 EFCSTPACSEGNSDCYFGNGSAYRGTHSLTESGASCLPWNSMILIGKVYT 250

171 AQNPSAQALGLGKHNYCRNPDGDAKPWCHVLKNRRLTWEYCDVPSCSTCG 220
    ||||||||||||||||||||||||||||||||||||||||||||||||||
251 AQNPSAQALGLGKHNYCRNPDGDAKPWCHVLKNRRLTWEYCDVPSCSTCG 300

221 LRQYSQPQFRIKGGLFADIASHPWQAAIFAKHRRSPGERFLCGGILISSC 270
    ||||||||||||||||||||||||||||||||||||||||||||||||||
301 LRQYSQPQFRIKGGLFADIASHPWQAAIFAKHRRSPGERFLCGGILISSC 350

271 WILSAAHCFQERFPPHHLTVILGRTYRVVPGEEEQKFEVEKYIVHKEFDD 320
    ||||||||||||||||||||||||||||||||||||||||||||||||||
351 WILSAAHCFQERFPPHHLTVILGRTYRVVPGEEEQKFEVEKYIVHKEFDD 400

321 DTYDNDIALLQLKSDSSRCAQESSVVRTVCLPPADLQLPDWTECELSGYG 370
    ||||||||||||||||||||||||||||||||||||||||||||||||||
401 DTYDNDIALLQLKSDSSRCAQESSVVRTVCLPPADLQLPDWTECELSGYG 450

371 KHEALSPFYSERLKEAHVRLYPSSRCTSQHLLNRTVTDNMLCAGDTRSGG 420
    ||||||||||||||||||||||||||||||||||||||||||||||||||
451 KHEALSPFYSERLKEAHVRLYPSSRCTSQHLLNRTVTDNMLCAGDTRSGG 500

421 PQANLHDACQGDSGGPLVCLNDGRMTLVGIISWGLGCGQKDVPGVYTKVT 470
    ||||||||||||||||||||||||||||||||||||||||||||||||||
501 PQANLHDACQGDSGGPLVCLNDGRMTLVGIISWGLGCGQKDVPGVYTKVT 550

471 NYLDWIRDNMRP                                       482
    ||||||||||||
551 NYLDWIRDNMRP                                       562
```

Figure 261

Alignment of: HUMUPAA_P17 (SEQ ID NO:1103) x TPA_HUMAN (SEQ ID NO:150)

```
  1 MDAMKRGLCCVLLLCGAVFVSPSQEIHARFRRGARSYQVICRDEKTQMIY  50
    ||||||||||||||||||||||||||||||||||||||||||||||||||
  1 MDAMKRGLCCVLLLCGAVFVSPSQEIHARFRRGARSYQVICRDEKTQMIY  50

51 QQHQSWLRPVLRSNRVEYCWCNSGRAQCHSVR..................  82
    |||||||||||||||||||||||||||||||
 51 QQHQSWLRPVLRSNRVEYCWCNSGRAQCHSVPVKSCSEPRCFNGGTCQQA 100

82 ..................................................  82

101 LYFSDFVCQCPEGFAGKCCEIDTRATCYEDQGISYRGTWSTAESGAECTN 150

82 ..................................................  82

151 WNSSALAQKPYSGRRPDAIRLGLGNHNYCRNPDRDSKPWCYVFKAGKYSS 200

83 ...........NSDCYFGNGSAYRGTHSLTESGASCLPWNSMILIGKVYT 121
               |||||||||||||||||||||||||||||||||||||||
201 EFCSTPACSEGNSDCYFGNGSAYRGTHSLTESGASCLPWNSMILIGKVYT 250

122 AQNPSAQALGLGKHNYCRNPDGDAKPWCHVLKNRRLTWEYCDVPSCSTCG 171
    |||||||||||||||||||||||||||||||||||||||||||||||||
251 AQNPSAQALGLGKHNYCRNPDGDAKPWCHVLKNRRLTWEYCDVPSCSTCG 300

172 LRQYSQPQFRIKGGLFADIASHPWQAAIFAKHRRSPGERFLCGGILISSC 221
    |||||||||||||||||||||||||||||||||||||||||||||||||
301 LRQYSQPQFRIKGGLFADIASHPWQAAIFAKHRRSPGERFLCGGILISSC 350

222 WILSAAHCFQERFPPHHLTVILGRTYRVVPGEEEQKFEVEKYIVHKEFDD 271
    |||||||||||||||||||||||||||||||||||||||||||||||||
351 WILSAAHCFQERFPPHHLTVILGRTYRVVPGEEEQKFEVEKYIVHKEFDD 400

272 DTYDNDIALLQLKSDSSRCAQESSVVRTVCLPPADLQLPDWTECELSGYG 321
    |||||||||||||||||||||||||||||||||||||||||||||||||
401 DTYDNDIALLQLKSDSSRCAQESSVVRTVCLPPADLQLPDWTECELSGYG 450

322 KHEALSPFYSERLKEAHVRLYPSSRCTSQHLLNRTVTDNMLCAGDTRSGG 371
    |||||||||||||||||||||||||||||||||||||||||||||||||
451 KHEALSPFYSERLKEAHVRLYPSSRCTSQHLLNRTVTDNMLCAGDTRSGG 500

372 PQANLHDACQGDSGGPLVCLNDGRMTLVGIISWGLGCGQKDVPGVYTKVT 421
    |||||||||||||||||||||||||||||||||||||||||||||||||
501 PQANLHDACQGDSGGPLVCLNDGRMTLVGIISWGLGCGQKDVPGVYTKVT 550

422 NYLDWIRDNMRP                                       433
    ||||||||||||
551 NYLDWIRDNMRP                                       562
```

Figure 262

Alignment of: HUMUPAA_P20 (SEQ ID NO:1104) x TPA_HUMAN (SEQ ID NO:150)

```
  1 MDAMKRGLCCVLLLCGAVFVSPSQEIHARFRRGARSYQ............  38
    |||||||||||||||||||||||||||||||||||||
  1 MDAMKRGLCCVLLLCGAVFVSPSQEIHARFRRGARSYQVICRDEKTQMIY  50

39 .................................GCSEPRCFNGGTCQQA  54
                                      |||||||||||||||||
 51 QQHQSWLRPVLRSNRVEYCWCNSGRAQCHSVPVKSCSEPRCFNGGTCQQA 100

55 LYFSDFVCH......................................... 63
    |||||||||:
101 LYFSDFVCQCPEGFAGKCCEIDTRATCYEDQGISYRGTWSTAESGAECTN 150

63 ..................................................  63

151 WNSSALAQKPYSGRRPDAIRLGLGNHNYCRNPDRDSKPWCYVFKAGKYSS 200

63 ..................................................  63

201 EFCSTPACSEGNSDCYFGNGSAYRGTHSLTESGASCLPWNSMILIGKVYT 250

64 .....AQALGLGKHNYCRNPDGDAKPWCHVLKNRRLTWEYCDVPSCSTCG 108
         ||||||||||||||||||||||||||||||||||||||||||||
251 AQNPSAQALGLGKHNYCRNPDGDAKPWCHVLKNRRLTWEYCDVPSCSTCG 300

109 LRQYSQPQFRIKGGLFADIASHPWQAAIFAKHRRSPGERFLCGGILISSC 158
    ||||||||||||||||||||||||||||||||||||||||||||||||||
301 LRQYSQPQFRIKGGLFADIASHPWQAAIFAKHRRSPGERFLCGGILISSC 350

159 WILSAAHCFQERFPPHHLTVILGRTYRVVPGEEEQKFEVEKYIVHKEFDD 208
    ||||||||||||||||||||||||||||||||||||||||||||||||||
351 WILSAAHCFQERFPPHHLTVILGRTYRVVPGEEEQKFEVEKYIVHKEFDD 400

209 DTYDNDIALLQLKSDSSRCAQESSVVRTVCLPPADLQLPDWTECELSGYG 258
    ||||||||||||||||||||||||||||||||||||||||||||||||||
401 DTYDNDIALLQLKSDSSRCAQESSVVRTVCLPPADLQLPDWTECELSGYG 450

259 KHEALSPFYSERLKEAHVRLYPSSRCTSQHLLNRTVTDNMLCAGDTRSGG 308
    ||||||||||||||||||||||||||||||||||||||||||||||||||
451 KHEALSPFYSERLKEAHVRLYPSSRCTSQHLLNRTVTDNMLCAGDTRSGG 500

309 PQANLHDACQGDSGGPLVCLNDGRMTLVGIISWGLGCGQKDVPGVYTKVT 358
    ||||||||||||||||||||||||||||||||||||||||||||||||||
501 PQANLHDACQGDSGGPLVCLNDGRMTLVGIISWGLGCGQKDVPGVYTKVT 550

359 NYLDWIRDNMRP                                       370
    ||||||||||||
551 NYLDWIRDNMRP                                       562
```

Figure 264

Alignment of: HUMDNASEI_PEA_1_P3 (SEQ ID NO:1127) x DRN1_HUMAN (SEQ ID NO:1131)

```
  8 LCRDAPDTYHYVVSEPLGRNSYKERYLFVYRPDQVSAVDSYYYDDGCEPC  57
    | :|||||||||||||||||||||||||||||||||||||||||||||||
 77 LNQDAPDTYHYVVSEPLGRNSYKERYLFVYRPDQVSAVDSYYYDDGCEPC 126

58 GNDTFNREPAIVRFFSRFTEVREFAIVPLHAAPGDAVAEIDALYDVYLDV 107
    |||||||||||||||||||||||||||||||||||||||||||||||||
127 GNDTFNREPAIVRFFSRFTEVREFAIVPLHAAPGDAVAEIDALYDVYLDV 176

108 QEKWGLEDVMLMGDFNAGCSYVRPSQWSSIRLWTSPTFQWLIPDSADTTA 157
    |||||||||||||||||||||||||||||||||||||||||||||||||
177 QEKWGLEDVMLMGDFNAGCSYVRPSQWSSIRLWTSPTFQWLIPDSADTTA 226

158 TPTHCAYDRIVVAGMLLRGAVVPDSALPFNFQAAYGLSDQLAQAISDHYP 207
    |||||||||||||||||||||||||||||||||||||||||||||||||
227 TPTHCAYDRIVVAGMLLRGAVVPDSALPFNFQAAYGLSDQLAQAISDHYP 276

208 VEVMLK                                             213
    ||||||
277 VEVMLK                                             282
```

Figure 265

Alignment of: HUMDNASEI_PEA_1_P4 (SEQ ID NO:1128) x DRN1_HUMAN (SEQ ID NO:1131)

```
  1 MRGMKLLGALLALAALLQGAVSLKIAAFNIQTFGETKMSNATLVSYIVQI  50
    ||||||||||||||||||||||||||||||||||||||||||||||||||
  1 MRGMKLLGALLALAALLQGAVSLKIAAFNIQTFGETKMSNATLVSYIVQI  50

51 LSRYDIALVQEVRDSHLTAVGKLLDNLNQDAPDTYHYVVSEPLGRNSYKE 100
    ||||||||||||||||||||||||||||||||||||||||||||||||||
 51 LSRYDIALVQEVRDSHLTAVGKLLDNLNQDAPDTYHYVVSEPLGRNSYKE 100

101 RYLFVYRPDQVSAVDSYYYDDGCEPCGNDTFNREPAIVRFFSRFTEVREF 150
    ||||||||||||||||||||||||||||||||||||||||||||||||||
101 RYLFVYRPDQVSAVDSYYYDDGCEPCGNDTFNREPAIVRFFSRFTEVREF 150

151 AIVPLHAAPGDAVAEIDALYDVYLDVQEKWGLEDVMLMGDFNAGCSYVRP 200
    ||||||||||||||||||||||||||||||||||||||||||||||||||
151 AIVPLHAAPGDAVAEIDALYDVYLDVQEKWGLEDVMLMGDFNAGCSYVRP 200

201 SQWSSIRLWTSPTFQWLIPDSADTTATPTHCAYDRIVVAGMLLRGAVVPD 250
    ||||||||||||||||||||||||||||||||||||||||||||||||||
201 SQWSSIRLWTSPTFQWLIPDSADTTATPTHCAYDRIVVAGMLLRGAVVPD 250

251 SALPFNFQAAYGLSDQL                                 267
    |||||||||||||||||
251 SALPFNFQAAYGLSDQL                                 267
```

Figure 266

Alignment of: HUMDNASEI_PEA_1_P6 (SEQ ID NO:1129) x DRN1_HUMAN (SEQ ID NO:1131)

```
  1 MRGMKLLGALLALAALLQGAVSLKIAAFNIQTFGETKMSNATLVSYIVQI  50
    ||||||||||||||||||||||||||||||||||||||||||||||||||
  1 MRGMKLLGALLALAALLQGAVSLKIAAFNIQTFGETKMSNATLVSYIVQI  50

51 LSRYDIALVQEVRDSHLTAVGKLLDNLNQDAPDTYHYVVSEPLGRNSYKE 100
    ||||||||||||||||||||||||||||||||||||||||||||||||||
 51 LSRYDIALVQEVRDSHLTAVGKLLDNLNQDAPDTYHYVVSEPLGRNSYKE 100

101 RYLFVYRPDQVSAVDSYYYDDGCEPCGNDTFNREPAIVRFFSRFTEVREF 150
    ||||||||||||||||||||||||||||||||||||||||||||||||||
101 RYLFVYRPDQVSAVDSYYYDDGCEPCGNDTFNREPAIVRFFSRFTEVREF 150

151 AIVPLHAAPGDAVAEIDALYDVYLDVQEKWGLEDVMLMGDFNAGCSYVRP 200
    ||||||||||||||||||||||||||||||||||||||||||||||||||
151 AIVPLHAAPGDAVAEIDALYDVYLDVQEKWGLEDVMLMGDFNAGCSYVRP 200

201 SQWSSIRLWTSPTFQWLIPDSADTTATPTHCAYDR                235
    |||||||||||||||||||||||||||||||||||
201 SQWSSIRLWTSPTFQWLIPDSADTTATPTHCAYDR                235
```

Figure 267

Alignment of: HUMDNASEI_PEA_1_P10 (SEQ ID NO:1130) x DRN1_HUMAN (SEQ ID NO:1131)

```
  1 MRGMKLLGALLALAALLQGAVSLKIAAFNIQTFGETKMSNATLVSYIVQI  50
    ||||||||||||||||||||||||||||||||||||||||||||||||||
  1 MRGMKLLGALLALAALLQGAVSLKIAAFNIQTFGETKMSNATLVSYIVQI  50

51 LSRYDIALVQEVRDSHLTAVGKLLDNLNQDAPDTYHYVVSEPLGRNSYKE 100
    ||||||||||||||||||||||||||||||||||||||||||||||||||
 51 LSRYDIALVQEVRDSHLTAVGKLLDNLNQDAPDTYHYVVSEPLGRNSYKE 100

101 RYLFVYRPDQVSAVDSYYYDDGCEPCGNDTFNREPAIVRFFSRFT      145
    |||||||||||||||||||||||||||||||||||||||||||||
101 RYLFVYRPDQVSAVDSYYYDDGCEPCGNDTFNREPAIVRFFSRFT      145
```

Figure 268

Alignment of: HUMTNFAA_PEA_1_P6 (SEQ ID NO:1144)  x  TNFA_HUMAN
(SEQ ID NO:1155)

```
 1 MSTESMIRDVELAEEALPKKTGGPQGSRRCLFLSLFSFLIVAGATTLFCL 50
   ||||||||||||||||||||||||||||||||||||||||||||||||||
 1 MSTESMIRDVELAEEALPKKTGGPQGSRRCLFLSLFSFLIVAGATTLFCL 50

51 LHFGVIGPQREE                                       62
   ||||||||||||
51 LHFGVIGPQREE                                       62
```

Figure 269

Alignment of: HUMTNFAA_PEA_1_P7 (SEQ ID NO:1145)  x  TNFA_HUMAN
(SEQ ID NO:1155)

```
 1 MSTESMIRDVELAEEALPKKTGGPQGSRRCLFLSLFSFLIVAGATTLFCL 50
   ||||||||||||||||||||||||||||||||||||||||||||||||||
 1 MSTESMIRDVELAEEALPKKTGGPQGSRRCLFLSLFSFLIVAGATTLFCL 50

51 LHFGVIGPQREE                                       62
   ||||||||||||
51 LHFGVIGPQREE                                       62
```

Figure 270

Alignment of: HUMTNFAA_PEA_1_P8 (SEQ ID NO:1146) x TNFA_HUMAN_V1 (SEQ ID NO:1147)

```
  1 MSTESMIRDVELAEEALPKKTGGPQGSRRCLFLSLFSFLIVAGATTLFCL  50
    ||||||||||||||||||||||||||||||||||||||||||||||||||
  1 MSTESMIRDVELAEEALPKKTGGPQGSRRCLFLSLFSFLIVAGATTLFCL  50

51 LHFGVIGPQREEFPRDLSLISPLAQA...............VTNPQAEG  84
    |||||||||||||||||||||||||                ||||||||
 51 LHFGVIGPQREEFPRDLSLISPLAQAVRSSSRTPSDKPVAHVVTNPQAEG 100

85 QLQWLNRRANALLANGVELRDNQLVVPSEGLYLIYSQVLFKGQGCPSTHV 134
    ||||||||||||||||||||||||||||||||||||||||||||||||||
101 QLQWLNRRANALLANGVELRDNQLVVPSEGLYLIYSQVLFKGQGCPSTHV 150

135 LLTHTISRIAVSYQTKVNLLSAIKSPCQRETPEGAEAKPWYEPIYLGGVF 184
    ||||||||||||||||||||||||||||||||||||||||||||||||||
151 LLTHTISRIAVSYQTKVNLLSAIKSPCQRETPEGAEAKPWYEPIYLGGVF 200

185 QLEKGDRLSAEINRPDYLDFAESGQVYFGIIAL                  217
    ||||||||||||||||||||||||||||||||
201 QLEKGDRLSAEINRPDYLDFAESGQVYFGIIAL                  233
```

Figure 271

Alignment of: MEC2_HUMAN (SEQ ID NO:1154) x M62144_P3 SEQ ID NO:1148) ..

```
  1 MVAGMLGLREEKSEDQDLQGLKDKPLKFKKVKKDKKEEKEGKHEPVQPSA  50
    |||||||||||||||||||||||||||||||||||||||||||||||||
  1 MVAGMLGLREEKSEDQDLQGLKDKPLKFKKVKKDKKEEKEGKHEPVQPSA  50

51 HHSAEPAEAGKAETSEGSGSAPAVPEASASPKQRRSIIRDRGPMYDDPTL 100
    |||||||||||||||||||||||||||||||||||||||||||||||||
 51 HHSAEPAEAGKAETSEGSGSAPAVPEASASPKQRRSIIRDRGPMYDDPTL 100

101 PEGWTRKLKQRKSGRSAGKYDVYLINPQGKAFRSKVELIAYFEKVGDTSL 150
    |||||||||||||||||||||||||||||||||||||||||||||||||
101 PEGWTRKLKQRKSGRSAGKYDVYLINPQGKAFRSKVELIAYFEKVGDTSL 150

151 DPNDFDFTVTGRGSPSRREQKPPKKPKSPKAPGTGRGRGRPKGSGTTRPK 200
    |||||||||||||||||||||||||||||||||||||||||||||||||
151 DPNDFDFTVTGRGSPSRREQKPPKKPKSPKAPGTGRGRGRPKGSGTTRPK 200

201 AATSEGVQVKRVLEKSPGKLLVKMPFQTSPGGKAEGGGATTSTQVMVIKR 250
    |||||||||||||||||||||||||||||||||||||||||||||||||
201 AATSEGVQVKRVLEKSPGKLLVKMPFQTSPGGKAEGGGATTSTQVMVIKR 250

251 PGRKRKAEADPQAIPKKRGRKPGSVVAAAAAEAKKKAVKESSIRSVQETV 300
    |||||||||||||||||||||||||||||||||||||||||||||||||
251 PGRKRKAEADPQAIPKKRGRKPGSVVAAAAAEAKKKAVKESSIRSVQETV 300

301 LPIKKRKTRETVSIEVKEVVKPLLVSTLGEKSGKGLKTCKSPGRKSKESS 350
    |||||||||||||||||||||||||||||||||||||||||||||||||
301 LPIKKRKTRETVSIEVKEVVKPLLVSTLGEKSGKGLKTCKSPGRKSKESS 350

351 PKGRSSSASSPPKKEHHHHHHHSESPKAPVPLLPPLPPPPPEPESSEDPT 400
    |||||||||||||||||||||||||||||
351 PKGRSSSASSPPKKEHHHHHHHSESP........................ 376

401 SPPEPQDLSSSVCKEEKMPRGGSLESDGCPKEPAKTQPAVATAATAAEKY 450

376 .................................................. 376

451 KHRGEGERKDIVSSSMPRPNREEPVDSRTPVTERVS                486

Alignment of: MEC2_HUMAN (SEQ ID NO:1154) x M62144_P2 (SEQ ID NO:1150)

```
  1 MVAGMLGLREEKSEDQDLQGLKDKPLKFKKVKKDKKEEKEGKHEPVQPSA  50
             |||||||||||||||||||||||||||||||||||||||||
 31 ........REEKSEDQDLQGLKDKPLKFKKVKKDKKEEKEGKHEPVQPSA  72

51 HHSAEPAEAGKAETSEGSGSAPAVPEASASPKQRRSIIRDRGPMYDDPTL 100
    |||||||||||||||||||||||||||||||||||||||||||||||||
 73 HHSAEPAEAGKAETSEGSGSAPAVPEASASPKQRRSIIRDRGPMYDDPTL 122

101 PEGWTRKLKQRKSGRSAGKYDVYLINPQGKAFRSKVELIAYFEKVGDTSL 150
    |||||||||||||||||||||||||||||||||||||||||||||||||
123 PEGWTRKLKQRKSGRSAGKYDVYLINPQGKAFRSKVELIAYFEKVGDTSL 172

151 DPNDFDFTVTGRGSPSRREQKPPKKPKSPKAPGTGRGRGRPKGSGTTRPK 200
    |||||||||||||||||||||||||||||||||||||||||||||||||
173 DPNDFDFTVTGRGSPSRREQKPPKKPKSPKAPGTGRGRGRPKGSGTTRPK 222

201 AATSEGVQVKRVLEKSPGKLLVKMPFQTSPGGKAEGGGATTSTQVMVIKR 250
    |||||||||||||||||||||||||||||||||||||||||||||||||
223 AATSEGVQVKRVLEKSPGKLLVKMPFQTSPGGKAEGGGATTSTQVMVIKR 272

251 PGRKRKAEADPQAIPKKRGRKPGSVVAAAAAEAKKKAVKESSIRSVQETV 300
    |||||||||||||||||||||||||||||||||||||||||||||||||
273 PGRKRKAEADPQAIPKKRGRKPGSVVAAAAAEAKKKAVKESSIRSVQETV 322

301 LPIKKRKTRETVSIEVKEVVKPLLVSTLGEKSGKGLKTCKSPGRKSKESS 350
    |||||||||||||||||||||||||||||||||||||||||||||||||
323 LPIKKRKTRETVSIEVKEVVKPLLVSTLGEKSGKGLKTCKSPGRKSKESS 372

351 PKGRSSSASSPPKKEHHHHHHHSESPKAPVPLLPPLPPPPPEPESSEDPT 400
    |||||||||||||||||||||||||||||||||||||||||||||||||
373 PKGRSSSASSPPKKEHHHHHHHSESPKAPVPLLPPLPPPPPEPESSEDPT 422

401 SPPEPQDLSSSVCKEEKMPRGGSLESDGCPKEPAKTQPAVATAATAAEKY 450
    |||||||||||||||||||||||||||||||||||||||||||||||||
423 SPPEPQDLSSSVCKEEKMPRGGSLESDGCPKEPAKTQPAVATAATAAEKY 472

451 KHRGEGERKDIVSSSMPRPNREEPVDSRTPVTERVS              486
    |||||||||||||||||||||||||||||||||||
473 KHRGEGERKDIVSSSMPRPNREEPVDSRTPVTERVS              508
```

Figure 273

Alignment of: MEC2_HUMAN (SEQ ID NO:1154) x M62144_P4 (SEQ ID NO:1152) ..

```
  1 MVAGMLGLREEKSEDQDLQGLKDKPLKFKKVKKDKKEEKEGKHEPVQPSA  50
    |||||||||||||||||||||||||||||||||||||||||||||||||
  1 MVAGMLGLREEKSEDQDLQGLKDKPLKFKKVKKDKKEEKEGKHEPVQPSA  50

51 HHSAEPAEAGKAETSEGSGSAPAVPEASASPKQRRSIIRDRGPMYDDPTL 100
    |||||||||||||||||||||||||||||||||||||||||||||||||
 51 HHSAEPAEAGKAETSEGSGSAPAVPEASASPKQRRSIIRDRGPMYDDPTL 100

101 PEGWTRKLKQRKSGRSAGKYDVYLINPQGKAFRSKVELIAYFEKVGDTSL 150
    |||||||||||||||||||||||||||||||||||||||||||||||||
101 PEGWTRKLKQRKSGRSAGKYDVYLINPQGKAFRSKVELIAYFEKVGDTSL 150

151 DPNDFDFTVTGRGSPSRREQKPPKKPKSPKAPGTGRGRGRPKGSTTRPK  200
    |||||||||||||||||||||||||||||||||||||||||||||||||
151 DPNDFDFTVTGRGSPSRREQKPPKKPKSPKAPGTGRGRGRPKGSTTRPK  200

201 AATSEGVQVKRVLEKSPGKLLVKMPFQTSPGGKAEGGGATTSTQVMVIKR 250
    |||||||||||||||||||||||||||||||||||||||||
201 AATSEGVQVKRVLEKSPGKLLVKMPFQTSPGGKAEGGGATTST....... 243

251 PGRKRKAEADPQAIPKKRGRKPGSVVAAAAAEAKKKAVKESSIRSVQETV 300

243 ................................................. 243

301 LPIKKRKTRETVSIEVKEVVKPLLVSTLGEKSGKGLKTCKSPGRKSKESS 350

243 ................................................. 243

351 PKGRSSSASSPPKKEHHHHHHHSESPKAPVPLLPPLPPPPPEPESSEDPT 400

243 ................................................. 243

401 SPPEPQDLSSSVCKEEKMPRGGSLESDGCPKEPAKTQPAVATAATAAEKY 450

243 ................................................. 243

451 KHRGEGERKDIVSSSMPRPNREEPVDSRTPVTERVS               486

243 ................................               243
```

US 7,939,634 B2

POLYNUCLEOTIDES ENCODING POLYPEPTIDES AND METHODS USING SAME

CROSS REFERENCE TO RELATED APPLICATIONS

The present application claims priority from U.S. Provisional Patent Application Nos. 60/607,246, filed Sep. 7, 2004, U.S. Provisional Patent Application No. 60/587,851, filed Jul. 15, 2004, and from U.S. Provisional Patent Application No. 60/539,127, filed Jan. 27, 2004, the contents of which are hereby incorporated by reference.

FIELD AND BACKGROUND OF THE INVENTION

The present invention relates to novel secreted and non-secreted polypeptides and polynucleotides encoding same and more particularly, to therapeutic and diagnostic methods and kits utilizing same.

Extracellular proteins including receptors and their corresponding ligands play active roles in the formation, differentiation and maintenance of multicellular organisms. Any fate of an individual cell including proliferation, migration, differentiation, or interaction with other cells is typically governed by information received from distant cells and/or the immediate environment. This information is often transmitted by secreted polypeptides such as, mitogenic factors, survival factors, cytotoxic factors, differentiation factors, neuropeptides, and hormones, which are, in turn, received and interpreted by diverse cell receptors or membrane-bound proteins. These secreted polypeptides or signaling molecules are normally transferred through the cellular secretory pathway to reach their site of action at the extracellular environment.

Secreted proteins have various industrial applications, including as pharmaceuticals, diagnostics, biosensors and bioreactors. Most protein drugs available to date, including thrombolytic polypeptide sequences, interferons, interleukins, erythropoietins, colony stimulating factors, and various other cytokines, are secretory proteins. Their receptors, which are membrane proteins, also have potential as therapeutic or diagnostic polynucleotide or polypeptide sequences. For example, receptor immunoadhesins can be employed as therapeutic polynucleotide or polypeptide sequences to block receptor-ligand interactions. The membrane-bound proteins can also be employed for screening of potential peptide or small molecule inhibitors of the relevant receptor/ligand interaction.

Non-secreted proteins may also find application as therapeutics or diagnostics. For example, over expression of an intracellular protein (or transcript thereof) which correlates with a disease may be used to diagnose the presence of a disease or for estimating the risk of developing a disease, by the development of probes which specifically identify the over-expressed transcript or protein. In instances where the individual is at risk of suffering from a disease or other undesirable phenotype as a result of over expression of such transcript, the expression of the protein may be reduced using, for example, antisense or triple helix based strategies.

For these reasons, efforts are being made by both industry and academia to identify new, native, membrane-bound, secreted or non-secreted proteins. Many efforts are focused on the screening of mammalian recombinant DNA libraries to identify the coding sequences for such proteins. Examples of such screening methods and techniques are described in, for example, Klein et al., Proc. Natl. Acad. Sci. 93:7108-7113 (1996); U.S. Pat. No. 5,536,637

The present inventors have previously designed algorithms which allow for the mass prediction of new genes and gene products and for annotating these genes and gene products [see U.S. Pat. No. 6,625,545; U.S. patent application Ser. No. 10/426,002; U.S. Patent Application No. 60/539,129 entitled Methods and systems for annotating biomolecular sequences and U.S. Patent Application No. 60/539,128 entitled METHODS OF IDENTIFYING PUTATIVE GENE PRODUCTS BY INTERSPECIES SEQUENCE COMPARISON filed concurrently herewith, assigned to the same assignee hereof and contain subject matter related, in certain respects, to the subject matter of the instant application, the teachings of all of which are incorporated herein by reference; and Example 1 of the Examples section which follows].

While applying the above-mentioned algorithms the present inventors uncovered novel naturally occurring variants of extracellular gene products, which as described above, play pivotal roles in disease onset and progression. As such these variants can be used in the diagnosis and therapy of a wide range of diseases.

SUMMARY OF THE INVENTION

According to one aspect of the present invention there is provided an isolated polynucleotide comprising a nucleic acid sequence encoding a polypeptide having an amino acid sequence at least 70% identical to SEQ ID NO: 1, as determined using the LALIGN software of EMBnet Switzerland using default parameters, a nucleic acid construct comprising said isolated polynucleotide, and a host cell comprising the nucleic acid construct.

According to further features in preferred embodiments of the invention described below the nucleic acid construct further comprises a promoter for regulating transcription of the isolated polynucleotide in sense or antisense orientation.

According to yet further features in preferred embodiments of the invention described below the nucleic acid construct further comprises positive and negative selection markers for selecting for homologous recombination events.

According to another aspect of the present invention there is provided an isolated polypeptide comprising an amino acid sequence at least 70% identical to SEQ ID NO: 1, as determined using the LALIGN software of EMBnet Switzerland using default parameters or an active portion thereof.

According to yet another aspect of the present invention there is provided an antibody or an antibody fragment being capable of specifically binding a polypeptide having an amino acid sequence at least 70% identical to SEQ ID NO: 1, as determined using the LALIGN software of EMBnet Switzerland using default parameters.

According to still another aspect of the present invention there is provided an oligonucleotide specifically hybridizable with a nucleic acid sequence encoding a polypeptide having an amino acid at least 70% identical to SEQ ID NO: 1, as determined using the LALIGN software of EMBnet Switzerland using default parameters.

According to another aspect of the present invention there is provided a pharmaceutical composition comprising a therapeutically effective amount of a polypeptide having an amino acid sequence at least 70% identical to SEQ ID NO: 1, as determined using the LALIGN software of EMBnet Switzerland using default parameters and a pharmaceutically acceptable carrier or diluent.

According to further features in preferred embodiments of the invention described below the nucleic acid sequence of the isolated polynucleotide is as set forth in SEQ ID NO: 3 or 4.

According to yet further features in preferred embodiments of the invention described below, the polypeptide encoded by said isolated polynucleotide is as set forth in SEQ ID NO: 1 or 2.

According to still another aspect of the present invention there is provided an isolated polynucleotide as set forth in SEQ ID NO: 3 or 4.

According to yet another aspect of the present invention there is provided an isolated polypeptide as set forth in SEQ ID NO: 1 or 2.

According to another aspect of the present invention there is provided a method of treating GCSF-related disease in a subject, the method comprising upregulating in the subject an expression level of a polypeptide having an amino acid sequence at least 70% identical to SEQ ID NO: 1 as determined using the LALIGN software of EMBnet Switzerland using default parameters, thereby treating the GCSF-related disease in a subject.

According to further features in preferred embodiments of the invention described below, upregulating the expression level of the polypeptide is effected by (i) administering the polypeptide to the subject; and/or (ii) administering an expressible polynucleotide encoding the polypeptide to the subject.

According to yet further features in preferred embodiments of the invention described below the expressible polynucleotide includes a nucleic acid sequence at least 90% to SEQ ID NO:3, or is as set forth in SEQ ID NO:3.

According to another aspect of the present invention there is provided an isolated polynucleotide comprising a nucleic acid sequence encoding a polypeptide having an amino acid sequence at least 70% identical to SEQ ID NO: 5, as determined using the LALIGN software of EMBnet Switzerland using default parameters, a nucleic acid construct comprising said isolated polynucleotide, and a host cell comprising the nucleic acid construct.

According to further features in preferred embodiments of the invention described below the nucleic acid construct further comprises a promoter for regulating transcription of the isolated polynucleotide in sense or antisense orientation.

According to yet further features in preferred embodiments of the invention described below the nucleic acid construct further comprises positive and negative selection markers for selecting for homologous recombination events.

According to another aspect of the present invention there is provided an isolated polypeptide comprising an amino acid sequence at least 70% identical to SEQ ID NO: 5, as determined using the LALIGN software of EMBnet Switzerland using default parameters or an active portion thereof.

According to yet another aspect of the present invention there is provided an antibody or an antibody fragment being capable of specifically binding a polypeptide having an amino acid sequence at least 70% identical to SEQ ID NO: 5, as determined using the LALIGN software of EMBnet Switzerland using default parameters.

According to still another aspect of the present invention there is provided an oligonucleotide specifically hybridizable with a nucleic acid sequence encoding a polypeptide having an amino acid at least 70% identical to SEQ ID NO: 5, as determined using the LALIGN software of EMBnet Switzerland using default parameters.

According to another aspect of the present invention there is provided a pharmaceutical composition comprising a therapeutically effective amount of a polypeptide having an amino acid sequence at least 70% identical to SEQ ID NO: 5, as determined using the LALIGN software of EMBnet Switzerland using default parameters and a pharmaceutically acceptable carrier or diluent.

According to further features in preferred embodiments of the invention described below the nucleic acid sequence of the isolated polynucleotide is as set forth in SEQ ID NO: 7 or 8.

According to yet further features in preferred embodiments of the invention described below, the polypeptide encoded by said isolated polynucleotide is as set forth in SEQ ID NO: 5 or 6.

According to still another aspect of the present invention there is provided an isolated polynucleotide as set forth in SEQ ID NO: 7 or 8.

According to yet another aspect of the present invention there is provided an isolated polypeptide as set forth in SEQ ID NO: 5 or 6.

According to another aspect of the present invention there is provided a method of treating TNR-3-related disease in a subject, the method comprising upregulating in the subject an expression level of a polypeptide having an amino acid sequence at least 70% identical to SEQ ID NO: 5 as determined using the LALIGN software of EMBnet Switzerland using default parameters, thereby treating the TNR-3-related disease in a subject.

According to further features in preferred embodiments of the invention described below, upregulating the expression level of the polypeptide is effected by (i) administering the polypeptide to the subject; and/or (ii) administering an expressible polynucleotide encoding the polypeptide to the subject.

According to yet further features in preferred embodiments of the invention described below the expressible polynucleotide includes a nucleic acid sequence at least 90% identical to SEQ ID NO:7, or is as set forth in SEQ ID NO:7.

According to another aspect of the present invention there is provided an isolated polynucleotide comprising a nucleic acid sequence encoding a polypeptide having an amino acid sequence at least 70% identical to SEQ ID NO: 9, as determined using the LALIGN software of EMBnet Switzerland using default parameters, a nucleic acid construct comprising said isolated polynucleotide, and a host cell comprising the nucleic acid construct.

According to further features in preferred embodiments of the invention described below the nucleic acid construct further comprises a promoter for regulating transcription of the isolated polynucleotide in sense or antisense orientation.

According to yet further features in preferred embodiments of the invention described below the nucleic acid construct further comprises positive and negative selection markers for selecting for homologous recombination events.

According to another aspect of the present invention there is provided an isolated polypeptide comprising an amino acid sequence at least 70% identical to SEQ ID NO: 9, as determined using the LALIGN software of EMBnet Switzerland using default parameters or an active portion thereof.

According to yet another aspect of the present invention there is provided an antibody or an antibody fragment being capable of specifically binding a polypeptide having an amino acid sequence at least 70% identical to SEQ ID NO: 9, as determined using the LALIGN software of EMBnet Switzerland using default parameters.

According to still another aspect of the present invention there is provided an oligonucleotide specifically hybridizable with a nucleic acid sequence encoding a polypeptide having an amino acid at least 70% identical to SEQ ID NO: 9, as determined using the LALIGN software of EMBnet Switzerland using default parameters.

According to another aspect of the present invention there is provided a pharmaceutical composition comprising a therapeutically effective amount of an IL-4 polypeptide having an amino acid sequence at least 70% identical to SEQ ID NO: 9, as determined using the LALIGN software of EMBnet Switzerland using default parameters and a pharmaceutically acceptable carrier or diluent.

According to further features in preferred embodiments of the invention described below the nucleic acid sequence of the isolated polynucleotide is as set forth in SEQ ID NO: 11 or 12.

According to yet further features in preferred embodiments of the invention described below, the polypeptide encoded by said isolated polynucleotide is as set forth in SEQ ID NO: 9 or 10.

According to still another aspect of the present invention there is provided an isolated polynucleotide as set forth in SEQ ID NO: 11 or 12.

According to yet another aspect of the present invention there is provided an isolated polypeptide as set forth in SEQ ID NO: 9 or 10.

According to another aspect of the present invention there is provided a method of treating IL-4-related disease in a subject, the method comprising upregulating in the subject an expression level of a polypeptide having an amino acid sequence at least 70% identical to SEQ ID NO: 9 as determined using the LALIGN software of EMBnet Switzerland using default parameters, thereby treating the IL-4-related disease in a subject.

According to further features in preferred embodiments of the invention described below, upregulating the expression level of the polypeptide is effected by (i) administering the polypeptide to the subject; and/or (ii) administering an expressible polynucleotide encoding the polypeptide to the subject.

According to yet further features in preferred embodiments of the invention described below the expressible polynucleotide includes a nucleic acid sequence at least 90% identical to SEQ ID NO:11, or is as set forth in SEQ ID NO:11.

According to another aspect of the present invention there is provided an isolated polynucleotide comprising a nucleic acid sequence encoding a polypeptide having an amino acid sequence at least 70% identical to SEQ ID NO: 13, as determined using the LALIGN software of EMBnet Switzerland using default parameters, a nucleic acid construct comprising said isolated polynucleotide, and a host cell comprising the nucleic acid construct.

According to further features in preferred embodiments of the invention described below the nucleic acid construct further comprises a promoter for regulating transcription of the isolated polynucleotide in sense or antisense orientation.

According to yet further features in preferred embodiments of the invention described below the nucleic acid construct further comprises positive and negative selection markers for selecting for homologous recombination events.

According to another aspect of the present invention there is provided an isolated polypeptide comprising an amino acid sequence at least 70% identical to SEQ ID NO: 13, as determined using the LALIGN software of EMBnet Switzerland using default parameters or an active portion thereof.

According to yet another aspect of the present invention there is provided an antibody or an antibody fragment being capable of specifically binding a polypeptide having an amino acid sequence at least 70% identical to SEQ ID NO: 13, as determined using the LALIGN software of EMBnet Switzerland using default parameters.

According to still another aspect of the present invention there is provided an oligonucleotide specifically hybridizable with a nucleic acid sequence encoding a polypeptide having an amino acid at least 70% identical to SEQ ID NO: 13, as determined using the LALIGN software of EMBnet Switzerland using default parameters.

According to another aspect of the present invention there is provided a pharmaceutical composition comprising a therapeutically effective amount of a polypeptide having an amino acid sequence at least 70% identical to SEQ ID NO: 13, as determined using the LALIGN software of EMBnet Switzerland using default parameters and a pharmaceutically acceptable carrier or diluent.

According to further features in preferred embodiments of the invention described below the nucleic acid sequence of the isolated polynucleotide is as set forth in SEQ ID NO: 15 or 16.

According to yet further features in preferred embodiments of the invention described below, the polypeptide encoded by said isolated polynucleotide is as set forth in SEQ ID NO: 13 or 14.

According to still another aspect of the present invention there is provided an isolated polynucleotide as set forth in SEQ ID NO: 15 or 16.

According to yet another aspect of the present invention there is provided an isolated polypeptide as set forth in SEQ ID NO: 13 or 14.

According to another aspect of the present invention there is provided a method of treating ITAV-related disease in a subject, the method comprising upregulating in the subject an expression level of a polypeptide having an amino acid sequence at least 70% identical to SEQ ID NO: 5 as determined using the LALIGN software of EMBnet Switzerland using default parameters, thereby treating the ITAV-related disease in a subject.

According to further features in preferred embodiments of the invention described below, upregulating the expression level of the polypeptide is effected by (i) administering the polypeptide to the subject; and/or (ii) administering an expressible polynucleotide encoding the polypeptide to the subject.

According to yet further features in preferred embodiments of the invention described below the expressible polynucleotide includes a nucleic acid sequence at least 90% identical to SEQ ID NO:15, or is as set forth in SEQ ID NO:15.

According to another aspect of the present invention there is provided an isolated polynucleotide comprising a nucleic acid sequence encoding a polypeptide having an amino acid sequence at least 70% identical to SEQ ID NO: 17, as determined using the LALIGN software of EMBnet Switzerland using default parameters, a nucleic acid construct comprising said isolated polynucleotide, and a host cell comprising the nucleic acid construct.

According to further features in preferred embodiments of the invention described below the nucleic acid construct further comprises a promoter for regulating transcription of the isolated polynucleotide in sense or antisense orientation.

According to yet further features in preferred embodiments of the invention described below the nucleic acid construct further comprises positive and negative selection markers for selecting for homologous recombination events.

According to another aspect of the present invention there is provided an isolated polypeptide comprising an amino acid sequence at least 70% identical to SEQ ID NO: 17, as determined using the LALIGN software of EMBnet Switzerland using default parameters or an active portion thereof.

According to yet another aspect of the present invention there is provided an antibody or an antibody fragment being capable of specifically binding a polypeptide having an amino acid sequence at least 70% identical to SEQ ID NO: 17, as determined using the LALIGN software of EMBnet Switzerland using default parameters.

According to still another aspect of the present invention there is provided an oligonucleotide specifically hybridizable with a nucleic acid sequence encoding a polypeptide having an amino acid at least 70% identical to SEQ ID NO: 17, as determined using the LALIGN software of EMBnet Switzerland using default parameters.

According to another aspect of the present invention there is provided a pharmaceutical composition comprising a therapeutically effective amount of a polypeptide having an amino acid sequence at least 70% identical to SEQ ID NO: 17, as determined using the LALIGN software of EMBnet Switzerland using default parameters and a pharmaceutically acceptable carrier or diluent.

According to further features in preferred embodiments of the invention described below the nucleic acid sequence of the isolated polynucleotide is as set forth in SEQ ID NO: 19 or 20.

According to yet further features in preferred embodiments of the invention described below, the polypeptide encoded by said isolated polynucleotide is as set forth in SEQ ID NO: 17 or 18.

According to still another aspect of the present invention there is provided an isolated polynucleotide as set forth in SEQ ID NO: 19 or 20.

According to yet another aspect of the present invention there is provided an isolated polypeptide as set forth in SEQ ID NO: 17 or 18.

According to another aspect of the present invention there is provided a method of treating INR-related disease in a subject, the method comprising upregulating in the subject an expression level of a polypeptide having an amino acid sequence at least 70% identical to SEQ ID NO: 17 as determined using the LALIGN software of EMBnet Switzerland using default parameters, thereby treating the INR-related disease in a subject.

According to further features in preferred embodiments of the invention described below, upregulating the expression level of the polypeptide is effected by (i) administering the polypeptide to the subject; and/or (ii) administering an expressible polynucleotide encoding the polypeptide to the subject.

According to yet further features in preferred embodiments of the invention described below the expressible polynucleotide includes a nucleic acid sequence at least 90% identical to SEQ ID NO:19, or is as set forth in SEQ ID NO:19.

According to an additional aspect of the present invention there is provided an isolated polynucleotide comprising a nucleic acid sequence encoding a polypeptide having an amino acid sequence at least 70% homologous to SEQ ID NO: 54, as determined using the BlastP software of the National Center of Biotechnology Information (NCBI) using default parameters, a nucleic acid construct comprising said isolated polynucleotide, and a host cell comprising the nucleic acid construct.

According to further features in preferred embodiments of the invention described below the nucleic acid construct further comprises a promoter for regulating transcription of the isolated polynucleotide in sense or antisense orientation.

According to yet further features in preferred embodiments of the invention described below the nucleic acid construct further comprises positive and negative selection markers for selecting for homologous recombination events. The isolated polynucleotide, wherein said nucleic acid sequence is as set forth in one of SEQ ID NO: 45-53.

According to a further aspect of the present invention said polypeptide is as set forth in one of SEQ ID NO: 54-61.

According to yet an additional aspect of the present invention there is provided an isolated polynucleotide as set forth in one of SEQ ID NO: 45-53.

According to an additional aspect of the present invention there is provided an isolated polypeptide as set forth in one of SEQ ID NO: 54-61.

According to yet an additional aspect of the present invention there is provided an isolated polypeptide comprising an amino acid sequence at least 70% homologous to SEQ ID NO: 54, as determined using the BlastP software of the National Center of Biotechnology information (NCBI) using default parameters or an active portion thereof.

According to still an additional aspect of the present invention there is provided an antibody or an antibody fragment being capable of specifically binding a polypeptide having an amino acid sequence at least 70% homologous to SEQ ID NO: 54, as determined using the BlastP software of the National Center of Biotechnology Information (NCBI) using default parameters.

According to yet an additional aspect of the present invention there is provided an oligonucleotide specifically hybridizable with a nucleic acid sequence encoding a polypeptide having an amino acid at least 70% homologous to SEQ ID NO: 54, as determined using the BlastP software of the National Center of Biotechnology Information (NCBI) using default parameters.

According to still an additional aspect of the present invention there is provided a method of diagnosing predisposition to, or presence of cancer in a subject, the method comprising determining an expression level of a polypeptide having an amino acid at least 70% homologous to SEQ ID NO: 54, as determined using the BlastP software of the National Center of Biotechnology Information (NCBI) using default parameters, or of a polynucleotide encoding said polypeptide in a biological sample obtained from the subject, wherein said level of said polynucleotide or said level of said polypeptide is correlatable with predisposition to, or presence or absence of cancer, thereby diagnosing predisposition to, or presence of cancer in the subject.

According to further features in preferred embodiments of the invention described below the cancer is selected from the group consisting of ovarian cancer, colon cancer and lung cancer.

According to yet further features in preferred embodiments of the invention described below said determining said expression level of said polypeptide is effected via an assay selected from the group consisting of immunohistochemistry, ELISA, RIA, Western blot analysis, FACS analysis, an immunofluorescence assay, and a light emission immunoassay.

According to further features in preferred embodiments of the invention described below said determining level of said polynucleotide is effected via an assay selected from the group consisting of PCR, RT-PCR, quantitative RT-PCR, chip hybridization, RNase protection, in-situ hybridization, primer extension, Southern blot, Northern blot and dot blot analysis.

According to yet an additional aspect of the present invention there is provided a kit for diagnosing cancer or a predisposition thereto in a subject, the kit comprising the antibody or antibody fragment being capable of specifically binding a polypeptide having an amino acid sequence at least 70% homologous to SEQ ID NO: 54, as determined using the BlastP software of the National Center of Biotechnology Information (NCBI) using default parameters and reagents for detecting hybridization of the antibody or antibody fragment.

According to further features in preferred embodiments of the invention described below the cancer is selected from the group consisting of ovarian cancer, colon cancer and lung cancer.

According to yet further features in preferred embodiments of the invention described below detecting hybridization of the antibody or antibody fragment is effected by an assay selected from the group consisting of immunohistochemistry, ELISA, RIA, Western blot analysis, FACS analysis, an immunofluorescence assay, and a light emission immunoassay.

According to still further features in preferred embodiments of the invention described below said antibody or antibody fragment is coupled to an enzyme.

According to further features in preferred embodiments of the invention described below said antibody or antibody fragment is coupled to a detectable moiety selected from the group consisting of a chromogenic moiety, a fluorogenic moiety, a radioactive moiety and a light-emitting moiety.

According to yet a further aspect of the present invention there is provided a kit for diagnosing cancer or a predisposition thereto in a subject, the kit comprising oligonucleotide specifically hybridizable with a nucleic acid sequence encoding a polypeptide having an amino acid at least 70% homologous to SEQ ID NO: 54, as determined using the BlastP software of the National Center of Biotechnology Information (NCBI) using default parameters.

According to further features in preferred embodiments of the invention described below the kit further comprising reagents for detecting hybridization of the oligonucleotide.

According to yet further features in preferred embodiments of the invention described below the cancer is selected from the group consisting of ovarian cancer and lung cancer.

According to yet a further aspect of the present invention there is provided an isolated E-Selectin T1 polypeptide comprising a first amino acid sequence being at least 90% homologous to amino acids 1-176 of wild type E-SElectin corresponding to LEM2_HUMAN, and a second amino acid sequence being at least 70%, optionally at least 80%, preferably at least 85%, more preferably at least 90% and most preferably at least 95% homologous to a polypeptide having the sequence SKSGSCLFLHLRW (SEQ ID NO:67), wherein said first and said second amino acid sequences are contiguous and in a sequential order.

According to yet a further aspect of the present invention there is provided an isolated polypeptide for a tail of E-Selectin T1, comprising a polypeptide having the sequence SKSGSCLFLHLRW (SEQ ID NO: 67).

According to yet a further aspect of the present invention there is provided an isolated L-Selectin T2 polypeptide comprising an amino acid sequence being at least 90% homologous to amino acids 1-254 of wild type L-Selectin corresponding to LEM1_HUMAN, contiguous to and in sequential order bridged by GE.

According to yet a further aspect of the present invention there is provided an isolated L-Selectin T3 polypeptide, comprising a first amino acid sequence being at least 90% homologous to amino acids 1-317 of wild type L-Selectin corresponding to LEM1_HUMAN, bridged by S and a second amino acid sequence being at least 90% homologous to amino acids 361-372 of wild type L-Selectin corresponding to LEM1_HUMAN, wherein said first amino acid is contiguous to said bridging amino acid and said second amino acid sequence is contiguous to said bridging amino acid, and wherein said first amino acid, said bridging amino acid and said second amino acid sequence are in a sequential order.

According to yet a further aspect of the present invention there is provided an isolated polypeptide for an edge portion of L-Selectin T3, comprising a first amino acid sequence being at least 90% homologous to amino acids 307-317 of wild type L-Selectin corresponding to LEM1_HUMAN, bridged by S and a second amino acid sequence being at least 90% homologous to amino acids 361-371 of wild type L-Selectin corresponding to LEM1_HUMAN, wherein said first amino acid is contiguous to said bridging amino acid and said second amino acid sequence is contiguous to said bridging amino acid, and wherein said first amino acid, said bridging amino acid and said second amino acid sequence are in a sequential order.

According to yet a further aspect of the present invention there is provided an isolated L-Selectin T6 polypeptide consisting essentially of an amino acid sequence being at least 90% homologous to amino acids 1-316 of wild type L-Selectin corresponding to LEM1_HUMAN, contiguous to and in sequential order bridged by SE.

According to yet a further aspect of the present invention there is provided an isolated Integrin alpha M variant T8 polypeptide, comprising a first amino acid sequence being at least 90% homologous to amino acids 1-288 of wild type Integrin alpha M, corresponding to ITAM_HUMAN, and a second amino acid sequence being at least 70%, optionally at least 80%, preferably at least 85%, more preferably at least 90% and most preferably at least 95% homologous to a polypeptide having the sequence NAALRLMLLWRVSM-WIHPPFNLQILLKSK (SEQ ID NO:79), wherein said first and said second amino acid sequences are contiguous and in a sequential order.

According to yet a further aspect of the present invention there is provided an isolated polypeptide for a tail of Integrin alpha M variant T8, comprising a polypeptide having the sequence NAALRLMLLWRVSMWIHPPFNLQILLKSK (SEQ ID NO:79).

According to yet a further aspect of the present invention there is provided an isolated Integrin alpha L variant T11 polypeptide, comprising a first amino acid sequence being at least 90% homologous to amino acids 1-745 of wild type Integrin alpha L, corresponding to ITAL_HUMAN, and a second amino acid sequence being at least 70%, optionally at least 80%, preferably at least 85%, more preferably at least 90% and most preferably at least 95% homologous to a polypeptide having the sequence VRRDG (SEQ ID NO:82), wherein said first and said second amino acid sequences are contiguous and in a sequential order.

According to yet a further aspect of the present invention there is provided an isolated polypeptide for a tail of Integrin alpha L variant T11, comprising a polypeptide having the sequence VRRDG (SEQ ID NO:82).

According to yet a further aspect of the present invention there is provided an isolated Integrin alpha IIb variant T9 polypeptide, comprising a first amino acid sequence being at least 90% homologous to amino acids 1-866 of wild type Integrin alpha IIb, corresponding to ITAB_HUMAN, and a second amino acid sequence being at least 90% homologous to amino acids 1020-1039 of wild type Integrin alpha IIb, corresponding to ITAB_HUMAN, wherein said first and said second amino acid sequences are contiguous and in a sequential order.

According to yet a further aspect of the present invention there is provided an isolated polypeptide for an edge portion of Integrin alpha IIb variant T9, comprising a first amino acid sequence being at least 90% homologous to amino acids 856-866 of wild type Integrin alpha IIb, corresponding to ITAB_HUMAN, and a second amino acid sequence being at least 90% homologous to amino acids 1020-1030 of wild type Integrin alpha IIb, corresponding to ITAB_HUMAN, wherein said first and said second amino acid sequences are contiguous and in a sequential order.

According to yet a further aspect of the present invention there is provided an isolated Integrin alpha IIb variant T8 polypeptide, comprising a first amino acid sequence being at least 90% homologous to amino acids 1-981 of wild type Integrin alpha IIb, corresponding to ITAB_HUMAN, and a second amino acid sequence being at least 90% homologous to amino acids 1021-1039 of wild type Integrin alpha IIb, corresponding to ITAB_HUMAN, wherein said first and said second amino acid sequences are contiguous and in a sequential order.

According to yet a further aspect of the present invention there is provided an isolated polypeptide for an edge portion of Integrin alpha IIb variant T8, comprising a first amino acid sequence being at least 90% homologous to amino acids 971-981 of wild type Integrin alpha IIb, corresponding to ITAB_HUMAN, and a second amino acid sequence being at least 90% homologous to amino acids 1021-1031 of wild type Integrin alpha IIb, corresponding to ITAB_HUMAN, wherein said first and said second amino acid sequences are contiguous and in a sequential order.

According to yet a further aspect of the present invention there is provided an isolated Integrin beta-7 variant T6 polypeptide, comprising a first amino acid sequence being at least 90% homologous to amino acids 1-191 of wild type Integrin beta-7, corresponding to ITB7_HUMAN, and a second amino acid sequence being at least 70%, optionally at least 80%, preferably at least 85%, more preferably at least 90% and most preferably at least 95% homologous to a polypeptide having the sequence EPSAASRPVSPCLFNHCPSLCQHPGLTRAPTCPPSC (SEQ ID NO:91), wherein said first and said second amino acid sequences are contiguous and in a sequential order.

According to yet a further aspect of the present invention there is provided an isolated polypeptide for a tail of Integrin beta-7 variant T6, comprising a polypeptide having the sequence EPSAASRPVSPCLFNHCPSLCQHPGLTRAPTCPPSC (SEQ ID NO:91).

According to yet a further aspect of the present invention there is provided an isolated Interleukin 13 Receptor 1 variant T1 polypeptide, comprising a first amino acid sequence being at least 90% homologous to amino acids 1-225 of wild type Interleukin 13 Receptor 1, corresponding to I13I_HUMAN, and a second amino acid sequence being at least 70%, optionally at least 80%, preferably at least 85%, more preferably at least 90% and most preferably at least 95% homologous to a polypeptide having the sequence GPTSPYCHIGDEVST (SEQ ID NO:94), wherein said first and said second amino acid sequences are contiguous and in a sequential order.

According to yet a further aspect of the present invention there is provided an isolated polypeptide for a tail of Interleukin 13 Receptor 1 variant T1, comprising a polypeptide having the sequence GPTSPYCHIGDEVST (SEQ ID NO:94).

According to yet a further aspect of the present invention there is provided an isolated Complement Component C1s variant T7 polypeptide, comprising a first amino acid sequence being at least 90% homologous to amino acids 1-423 of wild type Complement Component C1s, corresponding to C1S_HUMAN, and a second amino acid sequence being at least 70%, optionally at least 80%, preferably at least 85%, more preferably at least 90% and most preferably at least 95% homologous to a polypeptide having the sequence GLNSDLPESSSVRWQYHCAVGCQGRGEPPQPH (SEQ ID NO:97), wherein said first and said second amino acid sequences are contiguous and in a sequential order.

According to yet a further aspect of the present invention there is provided an isolated polypeptide for a tail of Complement Component C1s variant T7, comprising a polypeptide having the sequence GLNSDLPESSSVRWQYHCAVGCQGRGEPPQPH (SEQ ID NO:97).

According to yet a further aspect of the present invention there is provided an isolated Complement Component C1s variant T8 polypeptide, comprising a first amino acid sequence being at least 90% homologous to amino acids 1-65 of wild type Complement Component C1s, corresponding to C1S_HUMAN, bridged by Y and a second amino acid sequence being at least 90% homologous to amino acids 132-688 of wild type Complement Component C1s, corresponding to C1S_HUMAN, wherein said first amino acid is contiguous to said bridging amino acid and said second amino acid sequence is contiguous to said bridging amino acid, and wherein said first amino acid, said bridging amino acid and said second amino acid sequence are in a sequential order.

According to yet a further aspect of the present invention there is provided an isolated polypeptide for an edge portion of Complement Component C$_1$s variant T8, comprising a first amino acid sequence being at least 90% homologous to amino acids 55-65 of wild type Complement Component C1s, corresponding to C1S_HUMAN, bridged by Y and a second amino acid sequence being at least 90% homologous to amino acids 132-142 of wild type Complement Component C1s, corresponding to C1S_HUMAN, wherein said first amino acid is contiguous to said bridging amino acid and said second amino acid sequence is contiguous to said bridging amino acid, and wherein said first amino acid, said bridging amino acid and said second amino acid sequence are in a sequential order.

According to yet a further aspect of the present invention there is provided an isolated Complement Component C5 variant T7 polypeptide, comprising a first amino acid sequence being at least 90% homologous to amino acids 1-854 of wild type Complement Component C5 corresponding to CO5_HUMAN, and a second amino acid sequence being at least 70%, optionally at least 80%, preferably at least 85%, more preferably at least 90% and most preferably at least 95% homologous to a polypeptide having the sequence SLALSPRLECNGKISGQLQVRLPGSSDSPASASQVAGITGTHHHAQPT (SEQ ID NO:103), wherein said first and said second amino acid sequences are contiguous and in a sequential order.

According to yet a further aspect of the present invention there is provided an isolated polypeptide for a tail of Complement Component C5 variant T7, comprising a polypeptide having the sequence SLALSPRLECNGKISGQLQVRLPGSSDSPASASQVAGITGTHHHAQPT (SEQ ID NO:103).

According to yet a further aspect of the present invention there is provided an isolated Complement Component C5 variant T11 polypeptide, comprising a first amino acid sequence being at least 90% homologous to amino acids 1-292 of wild type Complement Component C5 corresponding to CO5_HUMAN, and a second amino acid sequence being at least 70%, optionally at least 80%, preferably at least 85%, more preferably at least 90% and most preferably at least 95% homologous to a polypeptide having the sequence RAEVR, wherein said first and said second amino acid sequences are contiguous and in a sequential order.

According to yet a further aspect of the present invention there is provided an isolated polypeptide for a tail of Complement Component C5 variant T11, comprising a polypeptide having the sequence RAEVR.

According to yet a further aspect of the present invention there is provided an isolated Complement Receptor CR1 variant T5 polypeptide, comprising a first amino acid sequence being at least 90% homologous to amino acids 1-162 of wild type Complement Component C5 corresponding to CR1_HUMAN, and a second amino acid sequence being at least 70%, optionally at least 80%, preferably at least 85%, more preferably at least 90% and most preferably at least 95% homologous to a polypeptide having the sequence SELKYPFLFLLPTHSNFSLE (SEQ ID NO:109), wherein said first and said second amino acid sequences are contiguous and in a sequential order.

According to yet a further aspect of the present invention there is provided an isolated polypeptide for a tail of Complement Receptor CR1 variant T5, comprising a polypeptide having the sequence SELKYPFLFLLPTHSNFSLE (SEQ ID NO:109).

According to yet a further aspect of the present invention there is provided an isolated Integrin alpha 4 variant T2 polypeptide, comprising a first amino acid sequence being at least 90% homologous to amino acids 1-697 of wild type Integrin alpha 4 corresponding to ITA4_HUMAN, and a second amino acid sequence being at least 70%, optionally at least 80%, preferably at least 85%, more preferably at least 90% and most preferably at least 95% homologous to a polypeptide having the sequence LFHFSH (SEQ ID NO:112), wherein said first and said second amino acid sequences are contiguous and in a sequential order.

According to yet a further aspect of the present invention there is provided an isolated polypeptide for a tail for Integrin alpha 4 variant T2, comprising a polypeptide having the sequence LFHFSH (SEQ ID NO:112).

According to yet a further aspect of the present invention there is provided an isolated Tissue plasminogen activator (t-PA) variant T6 polypeptide, comprising a first amino acid sequence being at least 90% homologous to amino acids 1-53 of wild type Tissue plasminogen activator, corresponding to TPA_HUMAN, bridged by H, and a second amino acid sequence being at least 90% homologous to amino acids 135-562 of TPA_HUMAN, wherein said first amino acid is contiguous to said bridging amino acid and said second amino acid sequence is contiguous to said bridging amino acid, and wherein said first amino acid, said bridging amino acid and said second amino acid sequence are in a sequential order.

According to yet a further aspect of the present invention there is provided an isolated polypeptide for an edge portion of Tissue plasminogen activator (t-PA) variant T6, comprising a first amino acid sequence being at least 90% homologous to amino acids 43-53 of wild type Tissue plasminogen activator, corresponding to TPA_HUMAN, bridged by H and a second amino acid sequence being at least 90% homologous to amino acids 135-145 of TPA_HUMAN, wherein said first amino acid is contiguous to said bridging amino acid and said second amino acid sequence is contiguous to said bridging amino acid, and wherein said first amino acid, said bridging amino acid and said second amino acid sequence are in a sequential order.

According to yet a further aspect of the present invention there is provided an isolated Tissue plasminogen activator (t-PA) variant T9 polypeptide, comprising a first amino acid sequence being at least 90% homologous to amino acids 1-180 of wild type Tissue plasminogen activator, corresponding to TPA_HUMAN, and a second amino acid sequence being at least 70%, optionally at least 80%, preferably at least 85%, more preferably at least 90% and most preferably at least 95% homologous to a polypeptide having the sequence TPVPRHWAWANIITAGILMGMPSPGATC (SEQ ID NO:117), wherein said first and said second amino acid sequences are contiguous and in a sequential order.

According to yet a further aspect of the present invention there is provided an isolated polypeptide for a tail of Tissue plasminogen activator (t-PA) variant T9, comprising a polypeptide having the sequence TPVPRHWAWANI-ITAGILMGMPSPGATC (SEQ ID NO: 117).

According to yet a further aspect of the present invention there is provided an isolated Thrombopoirtin variant T8 polypeptide, comprising a first amino acid sequence being at least 90% homologous to amino acids 1-132 of wild type Thrombopoietin corresponding to TPO_HUMAN, and a second amino acid sequence being at least 90% homologous to amino acids 160-353 of TPO_HUMAN, wherein said first and said second amino acid sequences are contiguous and in a sequential order.

According to yet a further aspect of the present invention there is provided an isolated polypeptide for an edge portion of Thrombopoirtin variant T8, comprising a first amino acid sequence being at least 90% homologous to amino acids 122-132 of TPO_HUMAN, and a second amino acid sequence being at least 90% homologous to amino acids 160-170 of TPO_HUMAN, wherein said first and said second amino acid sequences are contiguous and in a sequential order.

According to yet further aspect of the present invention there is provided an isolated chimeric polypeptide HSFLT_PEA_1_P10, comprising a first amino acid sequence being at least 90% homologous to MVSYWDTGV-LLCALLSCLLLTGSSSGSKLKD-PELSLKGTQHIMQAGQTLHLQ CRGEAAHKWSLPEM-VSKESERLSITKSACGRNGKQFCSTLTLNTAQANHTGF YSCKYLAVPTSKKKETESAIYIFISDT-GRPFVEMYSEIPEIIHMTEGRELVIPCRV TSP-NITVTLKKFPLDTLIPDGKRIIWDSRKG-FIISNATYKEIGLLTCEATVNGHL YKTNYLTHRQTNTIIDVQISTPRPVKLL-RGHTLVLNCTATTPLNTRVQMTWSY PDEKNKRAS-VRRRIDQSNSHANIFYSVLTIDKMQNKD-KGLYTCRVRSGPSFKS VNTSVHIYDKAFITVKHRKQQV-LETVAGKRSYRLSMKVKAFPSPEVVWLKD GLPATEKSARYLTRGYSLIIKDV-TEEDAGNYTILLSIKQSNVFKNLTATLIVNV KPQIYEKAVSSFPDPALYPLGSR-QILTCTAYGIPQPTIKWFWHPCNHNHSEARC DFCSN-NEESFILDADSNMGNRIESITQRMAI-IEGKNKMASTLVVADSRISGIYIC IASNKVGTVGRNISFYITDVPNGFHVN-LEKMPTEGEDLKLSCTVNKFLYRDVT WILLRTVN-NRTMHYSISKQKMAITKEHSITLNLTIM-NVSLQDSGTYACRARNV YTGEEILQKKEITIRDQEAPYLLRNLS-DHTVAISSSTTLDCHANGVPEPQITWF KNNHKIQQEP corresponding to amino acids 1-705 of VGR1_HUMAN, which also corresponds to amino acids 1-705 of HSFLT_PEA_1_P10, and a second amino acid sequence being at least 70%, optionally at least 80%, preferably at least 85%, more preferably at least 90% and most preferably at least 95% homologous to a polypeptide having the sequence ELYTSTPSSSSSSSPLSSSSSSSSSSSS corresponding to amino acids 706-733 of HSFLT_PEA__1_P10, wherein said first amino acid sequence and second amino acid sequence are contiguous and in a sequential order.

According to yet further aspect of the present invention there is provided and antibody or binding fragment thereof which specifically binds to the tail portion of the Vascular endothelial growth factor (VEGF) receptor HSFLT PEA-1 P10 of SEQ ID NO:533, wherein the tail portion consisting of the amino acid sequence ELYTSTSPSSSSSS-PLSSSSSSSSSSSS corresponding to amino acids 706-733 of SEQ ID NO:533.

According to additional aspect of the present invention there is provided a kit comprising an antibody or binding fragment thereof which specifically binds to the tail portion of the Vascular endothelial growth factor (VEGF) receptor HSFLT PEA-1 P10 of SEQ ID NO:533, wherein the tail portion consisting of the amino acid sequence ELYTSTSPSSSSSSSPLSSSSSSSSSSSS corresponding to amino acids 706-733 of SEQ ID NO:533, and at least one reagent for performing immunoassay.

According to yet further aspect of the present invention there is provided a method of detecting the binding of an antibody or binding fragment thereof which specifically binds to the tail portion of the Vascular endothelial growth factor (VEGF) receptor HSFLT PEA-1 P10 of SEQ ID NO:533, wherein the tail portion consisting of the amino acid sequence ELYTSTSPSSSSSSSPLSSSSSSSSSSSS corresponding to amino acids 706-733 of SEQ ID NO:533 to a polypeptide comprising the amino acids 706-733 SEQ ID NO:533 in a sample obtained from a patient.

According to certain embodiments, the patient is suspected of having a disease selected from the group consisting of cancer, diabetes, ulcers, peripheral vascular disease and ischemia.

BRIEF DESCRIPTION OF THE DRAWINGS

The invention is herein described, by way of example only, with reference to the accompanying drawings. With specific reference now to the drawings in detail, it is stressed that the particulars shown are by way of example and for purposes of illustrative discussion of the preferred embodiments of the present invention only, and are presented in the cause of providing what is believed to be the most useful and readily understood description of the principles and conceptual aspects of the invention. In this regard, no attempt is made to show structural details of the invention in more detail than is necessary for a fundamental understanding of the invention, the description taken with the drawings making apparent to those skilled in the art how the several forms of the invention may be embodied in practice.

In the drawings:

FIG. 3 is an amino acid sequence alignment between wild-type GCSF protein (SwissProt locus: CSF3_HUMAN; SEQ ID NO:128) and the protein variant of the present invention, as determined using the Smith&Waterman model query db, with the following parameters: -mode=qglobal -onestrand -gapext=0 -matrix=identity -out=g -gapop=40-dfmt=fastap.

FIG. 4 is a schematic illustration showing the protein domain structure of wild-type GCSF protein (SwissProt locus: CSF3_HUMAN) and the variant of the present invention (SEQ ID NO:1). Unique region is indicated by U and arrow (SEQ ID NO:2).

FIGS. 5a-b present the nucleic acid sequence (FIG. 5a) and amino acid sequence (FIG. 5b) of the TNR3 variant of the present invention (SEQ ID NOs:7 and 5, respectively), described in Example 3 of the Examples section which follows. The unique sequence is marked in bold and italics. The ATG and the stop codon are marked in bold and underlined.

FIG. 7 is an amino acid sequence alignment between wild-type TNR3 protein (GenBank Accession No. P36941; TRN3_HUMAN; SEQ ID NO:129) and the protein variant of the present invention, as determined using the Smith&Waterman model query db, with the following parameters: -mode=qglobal -onestrand -gapext=0 -matrix=identity -out=g -gapop=40-dfmt=fastap.

FIG. 8 is a schematic illustration showing the protein domain structure of wild-type TNR3 protein (SwissProt locus: TRN3_HUMAN) and the variant of the present invention (SEQ ID NO:5). Unique region is indicated by U and arrow (SEQ ID NO:6).

FIGS. 9a-b presents the nucleic acid sequence (FIG. 9a) and amino acid sequence (FIG. 9b) of the IL4R variant of the present invention (Variant T5) (SEQ ID NO:11 and 9, respectively), described in Example 4 of the Examples section which follows. The unique sequence is marked in bold and italics. The ATG and the stop codon are marked in bold and underlined.

FIG. 10 is an amino acid sequence alignment between wild-type IL4R protein (SwissProt accession: IL4R_Human) and the protein variant of the present invention, as determined using the Smith&Waterman model query db, with the following parameters: -mode=qglobal -onestrand -gapext=0- matrix=identity -out=g -gapop=40 -dfmt=fastap.

FIGS. 12a-b present the nucleic acid sequence (HUMVTNR_T5 (SEQ ID NO:15; FIG. 12a) and amino acid sequence (HUMVTNR_P5; SEQ ID NO:13, FIG. 12b) of the ITAV variant of the present invention (SEQ ID NOs:15 and 13, respectively), described in Example 5 of the Examples section which follows. The unique sequence is marked in bold and italics. The ATG and the stop codon are marked in bold and underlined.

FIG. 14 is an amino acid sequence alignment between wild-type ITAV protein (SwissProt locus: ITAV_HUMAN; P06756; SEQ ID NO:131) and the protein variant of the present invention, as determined using the Smith&Waterman model query db, with the following parameters: -mode=qglobal -onestrand -gapext=0-matrix=identity -out=g -gapop=40-dfmt=fastap.

FIG. 15 is a schematic illustration showing the protein domain structure of wild-type ITAV protein (ITAV_HUMAN; SEQ ID NO:131) and the variant of the present invention (SEQ ID NO:13). Unique region is indicated by U (SEQ ID NO:14).

FIGS. 16a-b present the nucleic acid sequence (FIG. 16a; SEQ ID NO:19) and amino acid sequence (FIG. 16b; SEQ ID NO:17) of the INR1 variant of the present invention (SEQ ID NOs:19 and 17, respectively), described in Example 6 of the Examples section which follows. The unique sequence is marked in bold and italics (SEQ ID NO:18). The ATG and the stop codon are marked in bold and underlined.

FIG. 18 is an amino acid sequence alignment between wild-type INR1 protein (SwissProt locus: INR1_HUMAN; GenBank Accession No. P17181; SEQ ID NO:132) and the protein variant of the present invention, as determined using the Smith&Waterman model query db, with the following parameters: -mode=qglobal -onestrand -gapext=0-matrix=identity -out=g -gapop=40-dfmt=fastap.

FIG. 19 is a schematic illustration showing the protein domain structure of wild-type INR1 protein (SwissProt locus: INR1_HUMAN; SEQ ID NO:132) and the INR1 variant T12 of the present invention (SEQ ID NO:17). Unique region is indicated by U and arrow (SEQ ID NO:18).

FIGS. 28a-b presents the nucleic acid sequence (FIG. 28a) and amino acid sequence (FIG. 28b) of the CD154 splice variant skipping exon 3 of the present invention. The novel splice variant of CD154 is described in Example 48 below. The unique sequence is marked in bold and italics. The ATG and the stop codon are marked in bold and underlined.

FIGS. 28c-d presents the amino acid sequence (FIG. 28c) and nucleic acid sequence alignment (FIG. 28d) of the CD154 splice variant skipping exon 3 of the present invention and the mRNA derived from Hyper IgM syndrome (Ramesh N, et al., Int Immunol. 1993 July; 5(7): 769-73; gi AAD13982), as described in Example 48 below. Unique amino acids shared by both polypeptides are marked in bold and italics Amino acids unique for the mutated form of CD154 derived from Hyper IgM syndrome patients are marked as italics.

FIG. 28e-f presents the nucleic acid sequence (FIG. 28e) and amino acid sequence (FIG. 28f) of the CD154 splice variant skipping exon 4 of the present invention. The novel splice variant of CD154 is described in Example 48 below. The ATG and the stop codon are marked in bold and underlined.

FIG. 29 is an amino acid sequence alignment between wild-type CD154 protein (TNF5_HUMAN; GenBank Accession No. P29965; SEQ ID NO:136) and the skipping exon 3 CD154 variant of the present invention, as determined using the BlastP algorithm and default parameters. The novel splice variant of CD154 is described in Example 48 below.

FIG. 30 is an amino acid sequence alignment between wild-type CD154 protein (TNF5_HUMAN; SEQ ID NO:136) and the skipping exon 4 protein variant of the present invention, as determined using the BlastP algorithm and default parameters. The amino acids crucial for CD40 binding and for integrin α2,βIII R binding are marked. The novel splice variant of CD154 is described in Example 48 below.

FIG. 31a presents the amino acid sequence of Macaca nemestrina CD154 protein (gi|21363028|sp|Q9BDM7|TNF5_MACNE; SEQ ID NO:137).

FIG. 31b is an amino acid sequence alignment between wild-type CD154 protein (TNF5_HUMAN; SEQ ID NO:136) and the Macaca nemestrina CD154 protein (gi|21363028|sp|Q9BDM7|TNF5_MACNE; SEQ ID NO:137), as determined using the BlastP algorithm and default parameters. The amino acids crucial for CD40 binding and for integrin α2, βIII R binding are marked in bold.

FIG. 31c is an amino acid sequence alignment between the CD154 skipping exon 4 splice variant of the present invention and the Macaca nemestrina CD154 protein (gi|21363028|sp|Q9BDM7|TNF5_MACNE; SEQ ID NO:137), as determined using the BlastP algorithm and default parameters. The novel splice variant of CD154 is described in Example 48 below.

FIG. 36 depicts the structure domain of the variants described in Example 50 in comparison to the known or wild-type (WT) protein FIGS. 37a-b present the nucleic acid sequence (FIG. 37a) and amino acid sequence (FIG. 37b) of the E-Selectin variant of the present invention (SEQ ID NO: 66 and 65, respectively), described in Example 17 below. The unique sequence is marked in bold and italics.

FIG. 39 is an amino acid sequence alignment between wild-type E-Selectin (SwissProt locus: LEM2_HUMAN; GenBank Accession No. P16581; SEQ ID NO:139) and the protein variant of the present invention, as determined using the Smith&Waterman model query db, with the following parameters: -mode=qglobal -onestrand -gapext=0- matrix=identity -out=g -gapop=40-dfmt=fastap.

FIGS. 41a-b present the nucleic acid sequence (FIG. 41a) and amino acid sequence (FIG. 41b) of the L-Selectin variant T2 of the present invention (SEQ ID NO: 69 and 68, respectively), described in Example 33 below. The unique sequence is marked in bold and italics. The ATG and the stop codon are marked in bold and underlined.

FIGS. 41c-d present the nucleic acid sequence (FIG. 41c) and amino acid sequence (FIG. 41d) of the L-Selectin variant T3 of the present invention (SEQ ID NOs:72 and 71, respectively), described in Example 33 below. The unique edge, giving rise to a unique sequence combination, is marked by H.

FIGS. 41e-f present the nucleic acid sequence (FIG. 41e) and amino acid sequence (FIG. 41o) of the L-Selectin variant T6 of the present invention (SEQ ID NOs:75 and 74, respectively), described in Example 33 below. The unique sequence is marked in bold and italics.

FIGS. 42a-b is a schematic illustration depicting the graphical viewer scheme presenting the new variants of L-Selectin (transcripts_T2, T3 and T6) as compared to the wild type mRNA. The EST supporting the new variant T2 and T6 are indicated (FIGS. 42a and 42b, respectively). Transcript indicated as "0" represents known mRNA. The pattern code is as in FIG. 2.

FIG. 43a-c is an amino acid sequence alignment between wild-type L-Selectin (SwissProt locus: LEM1_HUMAN; GenBank Accession No. P14151; SEQ ID NO:140) and the protein variants of the present invention, as determined using the Smith&Waterman model query db, with the following parameters: -mode=qglobal -onestrand -gapext=0- matrix=identity -out=g -gapop=40-dfmt=fastap. FIG. 43a is an alignment of L-selectin variant T2; FIG. 43b is an alignment of L-selectin variant T3; FIG. 43c is an alignment of L-selectin variant T6;

FIGS. 45a-b present the nucleic acid sequence (FIG. 45a; SEQ ID NO:78) and amino acid sequence (FIG. 45b; SEQ ID NO:77) of the Integrin alpha-M variant of the present invention (integrin α-M variant Transcript_T8), described in Example 8 of the Examples section which follows. The unique sequence is marked in bold and italics. Note that there is prediction of an SNP G→C at position 2 of the transcript of the new variant (SEQ ID NO:78).

FIG. 46 is a schematic illustration depicting the graphical viewer scheme presenting the new variant of Integrin alpha-M (transcript_T8) as compared to the wild type mRNA. The ESTs supporting the new variant are indicated. Transcript indicated as "0" represents known mRNA. The pattern code is as in FIG. 2.

FIG. 47 is an amino acid sequence alignment between wild-type Integrin alpha-M (SwissProt locus: ITAM_HUMAN; GenBank Accession No. P11215; SEQ ID NO:141) and the protein variant of the present invention, as determined using the Smith&Waterman model query db, with the following parameters: -mode=qglobal -onestrand -gapext=0- matrix=identity -out=g -gapop=40-dfmt=fastap.

FIGS. 49a-b present the nucleic acid sequence (FIG. 49a) and amino acid sequence (FIG. 49b) of the Integrin alpha-L variant of the present invention (SEQ ID NO: 81 and 80, respectively), described in Example 18 below. The unique sequence is marked in bold and italics. The ATG and the stop codon are marked in green.

FIG. 51 is an amino acid sequence alignment between wild-type Integrin alpha-L (SwissProt locus: ITAL_HUMAN; GenBank Accession No. P20701; SEQ ID NO:142) and the protein variant of the present invention, as determined using the Smith&Waterman model query db, with the following parameters: -mode=qglobal -onestrand -gapext=0- matrix=identity -out=g -gapop=40-dfmt=fastap.

FIGS. 53a-b present the nucleic acid sequence (FIG. 53a) and amino acid sequence (FIG. 53b) of the Integrin alpha-IIb variant of the present invention, transcript T9 (SEQ ID NOs: 84 and 83, respectively), described in Example 28 below. The new edge, giving rise to a unique sequence combination, is marked with "][".

FIGS. 54a-b present the nucleic acid sequence (FIG. 54a) and amino acid sequence (FIG. 54b) of the Integrin alpha-IIb variant of the present invention, transcript T8 (SEQ ID NOs: 87 and 86, respectively), described in Example 28 below. The new edge, giving rise to a unique sequence combination, is marked with "][".

FIG. 55a is an amino acid sequence alignment between wild-type Integrin alpha-IIb (SwissProt locus: ITAB_HUMAN; GenBank Accession No. P08514; SEQ ID NO:143) and the protein variant T9 of the present invention, as determined using the Smith&Waterman model query db, with the following parameters: -mode=qglobal -onestrand -gapext=0- matrix=identity -out=g -gapop=40-dfmt=fastap.

FIG. 55b is an amino acid sequence alignment between wild-type Integrin alpha-IIb (SwissProt locus: ITAB_HUMAN; SEQ ID NO:143) and the protein variant T8 of the present invention, as determined using the Smith&Waterman model query db, with the following parameters: -mode=qglobal -onestrand -gapext=0 -matrix=identity -out=g -gapop=40-dfmt=fastap.

FIGS. 57a-b present the nucleic acid sequence (FIG. 57a) and amino acid sequence (FIG. 57b) of the Integrin beta-7 variant of the present invention (SEQ ID NOs:90 and 89, respectively), described in Example 20 below. The unique sequence is marked in bold and italics.

FIG. 59 is an amino acid sequence alignment between wild-type Integrin beta-7 (SwissProt locus: ITB7_HUMAN; GenBank Accession No. P26010; SEQ ID NO:144) and the protein variant of the present invention, as determined using the Smith&Waterman model query db, with the following parameters: -mode=qglobal -onestrand -gapext=0- matrix=identity -out=g -gapop=40-dfmt=fastap.

FIGS. 61a-b present the nucleic acid sequence (FIG. 61a) and amino acid sequence (FIG. 61b) of the Interleukin 13 receptor alpha-1 (IL-13-RA1) variant of the present invention (SEQ ID NOs:93 and 92, respectively), described in Example 31 below. The unique sequence is marked in bold and italics.

FIG. 63 is an amino acid sequence alignment between wild-type Interleukin 13 receptor alpha-1 (SwissProt locus: I131_HUMAN; GenBank Accession No. P78552; SEQ ID NO:145) and the protein variant of the present invention, as determined using the Smith&Waterman model query db, with the following parameters: -mode=qglobal -onestrand -gapext=0-matrix=identity -out=g -gapop=40-dfmt=fastap.

FIGS. 65a-b present the nucleic acid sequence (FIG. 65a) and amino acid sequence (FIG. 65b) of the Complement component C1s variant transcript T7 of the present invention (SEQ ID NOs:99 and 98, described in Example 26 below. The unique sequence is marked in bold and italics.

FIGS. 65c-d present the nucleic acid sequence (FIG. 65c) and amino acid sequence (FIG. 65d) of the Complement component C1s variant transcript T8 of the present invention (SEQ ID NOs:96 and 95, respectively), described in Example 26 below. The new edge, giving rise to a unique sequence combination, is marked with "][".

FIG. 67a is an amino acid sequence alignment between wild-type Complement component C1s (SwissProt locus: C1S_HUMAN; GenBank Accession No. P09871; SEQ ID NO:146) and the protein variant of the present invention, T7, as determined using the Smith&Waterman model query db, with the following parameters: -mode=qglobal -onestrand -gapext=0-matrix=identity -out=g -gapop=40-dfmt=fastap.

FIG. 67b is an amino acid sequence alignment between wild-type Complement component C1s (SwissProt locus: C1S_HUMAN; SEQ ID NO:146) and the protein variant of the present invention, T8, as determined using the Smith&Waterman model query db, with the following parameters: -mode=qglobal -onestrand -gapext=0 -matrix=identity -out=g -gapop=40-dfmt=fastap.

FIGS. 69a-b present the nucleic acid sequence (FIG. 69a) and amino acid sequence (FIG. 69b) of the Complement component C5 variant transcript T7 of the present invention (SEQ ID NOs:102 and 101, respectively), described in Example 21 below. The unique sequence is marked in bold and italics.

FIGS. 69c-d present the nucleic acid sequence (FIG. 69c) and amino acid sequence (FIG. 69d) of the Complement component C5 variant transcript T11 of the present invention (SEQ ID NOs:105 and 104, respectively), described in Example 21 below. The unique sequence is marked in bold and italics.

FIGS. 70a-b is a schematic illustration depicting the graphical viewer scheme presenting the new variants of Complement component C5 (FIG. 70a is for transcript_T7 and FIG. 70b is for transcript T11) as compared to the wild type mRNA. The ESTs supporting the new variants are indicated. Transcript indicated as "0" represents known mRNA. The pattern code is as in FIG. 2.

FIG. 71a is an amino acid sequence alignment between wild-type Complement component C5 (SwissProt locus: CO5_HUMAN; GenBank Accession No. P01031; SEQ ID NO:147) and the protein variant of the present invention, T7, as determined using the Smith&Waterman model query db, with the following parameters: -mode=qglobal -onestrand -gapext=0-matrix=identity -out=g -gapop=40-dfmt=fastap.

FIG. 71b is an amino acid sequence alignment between wild-type Complement component C5 (SwissProt locus: CO5_HUMAN; SEQ ID NO:147) and the protein variant of the present invention, T11, as determined using the Smith&Waterman model query db, with the following parameters: -mode=qglobal -onestrand -gapext=0 -matrix=identity -out=g -gapop=40-dfmt=fastap.

FIG. 72 is a schematic illustration showing the protein domain structure of wild-type Complement component C5 (SwissProt locus: CO5_HUMAN; SEQ ID NO:147) and the variants of the present invention (SEQ ID NO: 101 and 104). Unique regions are indicated (SEQ ID NO: 103 and 106).

FIGS. 73a-b present the nucleic acid sequence (FIG. 65a) and amino acid sequence (FIG. 65b) of the Complement Receptor CR1 variant transcript T5 of the present invention (SEQ ID NOs:108 and 107, respectively), described in Example 25 below. The unique sequence is marked in bold and italics.

FIG. 75 is an amino acid sequence alignment between wild-type Complement Receptor CR1 (SwissProt locus: CR1_HUMAN; GenBank Accession No. P17927; SEQ ID NO:148) and the protein variant of the present invention, T5, as determined using the Smith&Waterman model query db, with the following parameters: -mode=qglobal -onestrand -gapext=0-matrix=identity -out=g -gapop=40-dfmt=fastap.

FIG. 77 represents the nucleic acid sequence of the Integrin alpha 4 variant of the present invention (SEQ ID NO: 111), described in Example 29 below. The unique sequence is marked in bold and italics.

FIG. 78 represents the amino acid sequence of the Integrin alpha 4 variant of the present invention (SEQ ID NO:110), described in Example 29 below. The unique sequence is marked in bold and italics.

FIG. 80 is an amino acid sequence alignment between wild-type Integrin alpha 4 (SwissProt locus: ITA4_HUMAN; GenBank Accession No. P13612; SEQ ID NO:149) and the protein variant of the present invention, as determined using the Smith&Waterman model query db, with the following parameters: -mode=qglobal -onestrand -gapext=0-matrix=identity -out=g -gapop=40-dfmt=fastap.

FIG. 81 is a schematic illustration showing the protein domain structure of wild-type Integrin alpha 4 (SwissProt locus: ITA4_HUMAN; SEQ ID NO:149) and the variant of the present invention (SEQ ID NO:110). Unique region is indicated (SEQ ID NO:112).

FIGS. 82a-b present the nucleic acid sequence (FIG. 82a) and amino acid sequence (FIG. 82b) of the Tissue plasminogen activator (tPA) variant, transcript T6, of the present invention (SEQ ID NOs:114 and 113, respectively), described in Example 32 below. The new edge giving rise to a unique sequence junction is marked with "][".

FIGS. 82c-d present the nucleic acid sequence (FIG. 82c) and amino acid sequence (FIG. 82d) of the Tissue plasminogen activator (tPA) variant, transcript T9, of the present invention (SEQ ID NOs:116 and 115, respectively), described in Example 32 below. The unique sequence is marked in bold and italics. The new edge giving rise to a unique sequence junction is marked with "][".

FIG. 84a is an amino acid sequence alignment between wild-type Tissue plasminogen activator (tPA) (SwissProt locus: TPA_HUMAN; GenBank Accession No. P00750; SEQ ID NO:150) and the protein variant of the present invention, Tissue plasminogen activator (tPA) transcript_T6 (HUMUPAA_P4), as determined using the Smith&Waterman model query db, with the following parameters: -mode=qglobal -onestrand -gapext=0-matrix=identity -out=g -gapop=40-dfmt=fastap.

FIG. 84b is an amino acid sequence alignment between wild-type Tissue plasminogen activator (tPA) (SwissProt locus: TPA_HUMAN; SEQ ID NO:150) and the protein variant of the present invention, Tissue plasminogen activator (tPA) transcript_T9, as determined using the Smith&Waterman model query db, with the following parameters: -mode=qglobal -onestrand -gapext=0- matrix=identity -out=g -gapop=40-dfmt=fastap.

FIG. 85 is a schematic illustration showing the protein domain structure of wild-type Tissue plasminogen activator (tPA) (SwissProt locus: TPA_HUMAN; SEQ ID NO:150) and the variants of the present invention (SEQ ID NOs:113 and 115). Unique region is indicated (SEQ ID NO:117).

FIGS. 86*a-b* present the nucleic acid sequence (FIG. 86*a*) and amino acid sequence (FIG. 86*b*) of the Thrombopoietin variant, transcript T8, of the present invention (SEQ ID NOs: 119 and 118, respectively), described in Example 40 below. The new edge giving rise to a unique sequence junction is marked with "][".

FIG. 88 is an amino acid sequence alignment between wild-type
Thrombopoietin (SwissProt locus: TPO_HUMAN; GenBank Accession No. P40225; SEQ ID NO:151) and the protein variant of the present invention, Thrombopoietin transcript_T8, as determined using the Smith&Waterman model query db, with the following parameters: -mode=qglobal -onestrand -gapext=0-matrix=identity -out=g -gapop=40- dfmt=fastap.

FIG. 90 is an amino acid sequence alignment between wild-type Bone morphogenetic protein receptor type II (SwissProt locus: BMR2_HUMAN; GenBank Accession No. Q13873; SEQ ID NO:152) and the protein variant of the present invention, Bone morphogenetic protein receptor type II variant (HSU20165_P5 (SEQ ID NO:120), described in Example 22, as determined using the Smith&Waterman model query db, with the following parameters: -mode=qglobal -onestrand -gapext=0 -matrix=identity -out=g -gapop=40-dfmt=fastap.

FIG. 92 is an amino acid sequence alignment between wild-type Atrial natriuretic peptide receptor B (SwissProt locus: ANPB_HUMAN; GenBank Accession No. P20594; SEQ ID NO:153) and the protein variant of the present invention, Atrial natriuretic peptide receptor B variant, described in Example 35, as determined using the Smith&Waterman model query db, with the following parameters: -mode=qglobal -onestrand -gapext=0-matrix=identity -out=g -gapop=40 -dfmt=fastap.

FIG. 94*a-b* is an amino acid sequence alignment between wild-type Intracellular adhesion molecule 2 (SwissProt locus: ICA2_HUMAN; GenBank Accession No. P13598; SEQ ID NO:154) and the protein variants of the present invention, Intracellular adhesion molecule 2 variant T12 (FIGS. 94*a*) and T8 FIG. 94*b*), described in Example 41, as determined using the Smith&Waterman model query db, with the following parameters: -mode=qglobal -onestrand -gapext=0 -matrix=identity -out=g -gapop=40-dfmt=fastap.

FIG. 95 is a schematic illustration showing the protein domain structure of wild-type Intracellular adhesion molecule 2 (SwissProt locus: ICA2_HUMAN; SEQ ID NO:154) and the variants of the present invention (SEQ ID NOs:124 and 126).

FIGS. 96*a-b* present the nucleic acid sequence (FIG. 96*a*; HSIFNABR_T14) and amino acid sequence (FIG. 96*b*; HSIFNABR_P8) of the INR2 receptor variant, transcript T14, of the present invention (SEQ ID NOs:156 and 155, respectively), described in Example 9 of the Examples section which follows.

FIG. 97 is an amino acid sequence alignment between wild-type INR2 protein (GenBank Accession No. P48551; INR2_HUMAN; SEQ ID NO:157) and the protein variant of the present invention, HSIFNABR_P8 (SEQ ID NO:155) as determined using the Smith&Waterman model query db, with the following parameters: -mode=qglobal -onestrand -gapext=0-matrix=identity -out=g -gapop=40-dfmt=fastap. Note the presence of a unique amino acid sequence (marked in yellow; SEQ ID NO:158) in the variant of the present invention.

FIGS. 98*a-b* present the nucleic acid sequence (FIG. 98*a*; Z42185_T13) and amino acid sequence (FIG. 98*b*; Z42185_P5) of the TR14 variant, transcript T13, of the present invention (SEQ ID NOs:159 and 160, respectively), described in Example 11 of the Examples section which follows.

FIG. 99 is an amino acid sequence alignment between wild-type TR14 protein (GenBank Accession No. Q92956; TR14_HUMAN; SEQ ID NO:161) and the protein variant of the present invention, Z42185_P5 (SEQ ID NO:160) as determined using the Smith&Waterman model query db, with the following parameters: -mode=qglobal -onestrand -gapext=0- matrix=identity -out=g -gapop=40-dfmt=fastap. Note the presence of a unique amino acid sequence (marked in yellow; SEQ ID NO:162) in the variant of the present invention.

FIGS. 100*a-b* present the nucleic acid sequence (FIG. 100*a*; HUMLAP_T18) and amino acid sequence (FIG. 100*b*; HUMLAP_P15) of the ITB2 (integrin β2) variant, transcript T18, of the present invention (SEQ ID NOs:163 and 164, respectively), described in Example 12 of the Examples section which follows.

FIG. 101 is an amino acid sequence alignment between wild-type ITB2 protein (GenBank Accession No. P05107; ITB2_HUMAN; SEQ ID NO:165) and the protein variant of the present invention, HUMLAP_P15 (SEQ ID NO:164) as determined using the Smith&Waterman model query db, with the following parameters: -mode=qglobal -onestrand -gapext=0-matrix=identity -out=g -gapop=40 -dfmt=fastap. Note the presence of a unique amino acid sequence (marked in yellow; SEQ ID NO:166) in the variant of the present invention.

FIG. 102 is an amino acid sequence alignment between wild-type protein (ITB2_HUMAN; SEQ ID NO: 165) and the protein variant of the present invention, HUMLAP_P12 (SEQ ID NO: 168), described in Example 13 of the Examples section which follows, as determined using the Smith&Waterman model query db, with the following parameters: -mode=qglobal -onestrand -gapext=0- matrix=identity -out=g -gapop=40-dfmt=fastap. Note the presence of a unique amino acid sequence (marked in yellow; SEQ ID NO:169) in the variant of the present invention.

FIG. 103 is an amino acid sequence alignment between wild-type protein (FC3A_HUMAN; SEQ ID NO: 173) and the protein variant of the present invention, HUMGCRFC_P3 (SEQ ID NO:171), described in Example 14 of the Examples section which follows, as determined using the Smith&Waterman model query db, with the following parameters: -mode=qglobal -onestrand -gapext=0- matrix=identity -out=g -gapop=40-dfmt=fastap. Note the presence of a unique amino acid sequence (marked in yellow; SEQ ID NO:172) in the variant of the present invention.

FIG. 104 is an amino acid sequence alignment between wild-type protein [FC3A_HUMAN (SEQ ID NO:173)] and the protein variant of the present invention, HUMGCRFC_P4 (SEQ ID NO:175), described in Example 14 of the Examples section which follows, as determined using the Smith&Waterman model query db, with the following parameters: -mode=qglobal -onestrand -gapext=0- matrix=identity -out=g -gapop=40-dfmt=fastap. Note the presence of a unique amino acid sequence (marked in yellow; SEQ ID NO:176) in the variant of the present invention.

FIG. 105 is an amino acid sequence alignment between wild-type protein [TNR3_HUMAN (SEQ ID NO:129)] and the protein variant of the present invention, HUMTNFR-RP_P2 (SEQ ID NO:178), described in Example 15 of the Examples section which follows, as determined using the Smith&Waterman model query db, with the following parameters: -mode=qglobal -onestrand -gapext=0- matrix=identity -out=g -gapop=40-dfmt=fastap. Note the presence of a unique amino acid sequence (marked in yellow; SEQ ID NO:179) in the variant of the present invention.

Figure 2:
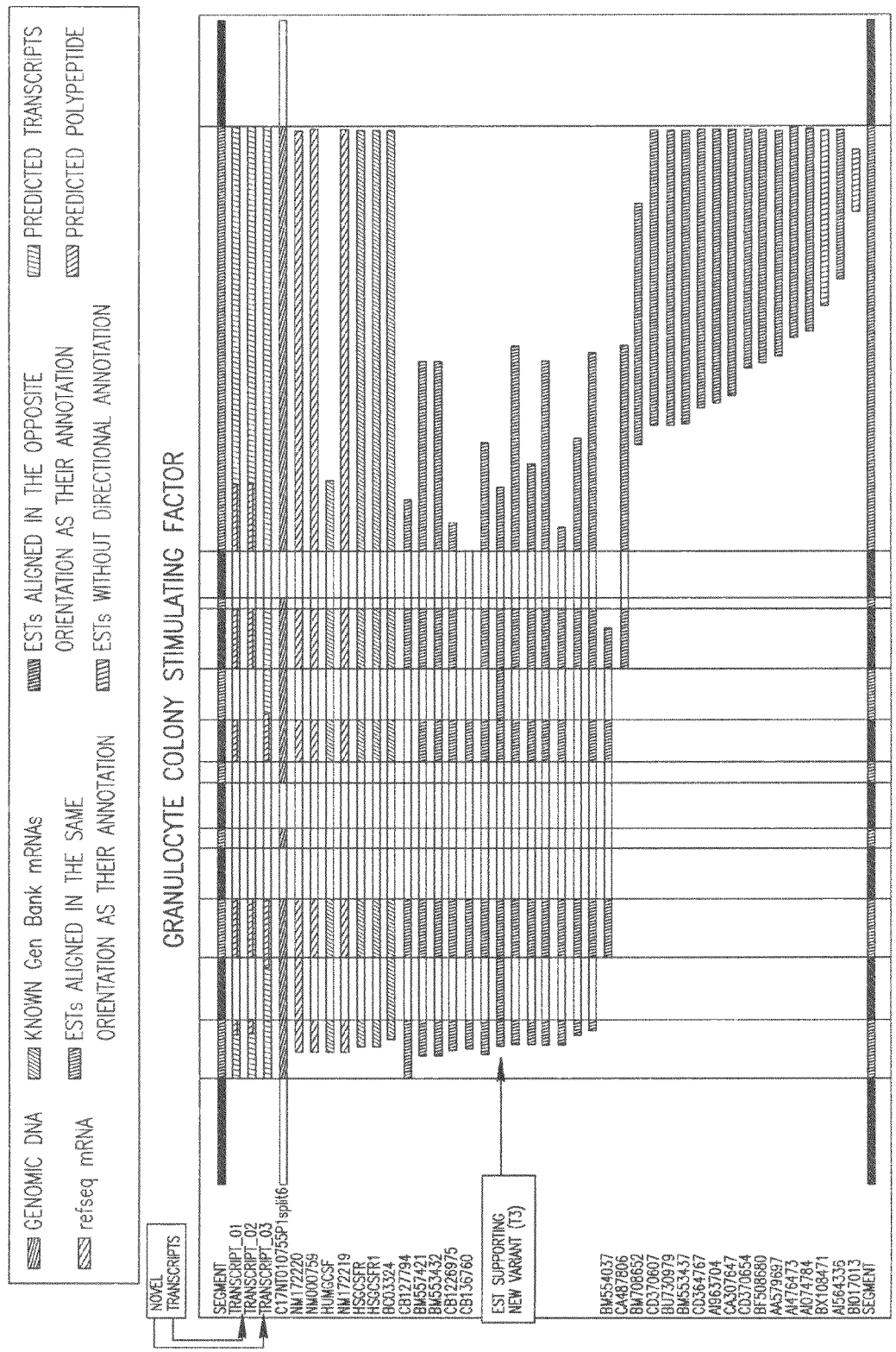
FIG. 2 is a schematic illustration depicting the graphical viewer scheme presenting the new variant of GCSF (transcript_3) as compared to the wild type mRNA. The ESTs supporting the new variant are indicated. Transcript indicated as "0" represents known mRNA. The pattern code is as follows: ▬=genomic DNA; ▬=refseq mRNA; ▬=known GenBank mRNAs; ▬=ESTs aligned in the same orientation as their annotation; ▬=ESTs aligned in the opposite orientation to their annotation; ▬=ESTs without direction annotation; ▬=predicted transcripts; ▬=predicted polypeptide.

FIG. 106 is an amino acid sequence alignment between wild-type protein GCSR_HUMAN (SEQ ID NO:183) and the protein variant of the present invention, HSGCSFR2_P11 (SEQ ID NO:182), described in Example 16 of the Examples section which follows, as determined using the Smith&Waterman model query db, with the following parameters: -mode=qglobal -onestrand -gapext=0- matrix=identity out=g -gapop=40-dfmt=fastap. Note the presence of a unique amino acid sequence (marked in yellow; SEQ ID NO:184) in the variant of the present invention.

FIG. 107 is an amino acid sequence alignment between wild-type protein GCSR_HUMAN (SEQ ID NO:183) and the protein variant of the present invention, HSGCSFR2_P7 (SEQ ID NO:186), described in Example 16 of the Examples section which follows, as determined using the Smith&Waterman model query db, with the following parameters: -mode=qglobal -onestrand -gapext=0- matrix=identity -out=g -gapop=40-dfmt=fastap. Note the absence of amino acid sequence (marked in yellow; SEQ ID NO:187) in the variant of the present invention.

FIG. 108 is an amino acid sequence alignment between wild-type protein GCSR_HUMAN (SEQ ID NO:183) and the protein variant of the present invention, HSGCSFR2_P8 (SEQ ID NO:189), described in Example 16 of the Examples section which follows, as determined using the Smith&Waterman model query db, with the following parameters: -mode=qglobal -onestrand -gapext=0- matrix=identity -out=g -gapop=40-dfmt=fastap. Note the presence of a unique amino acid sequence (marked in bold and italics; SEQ ID NO:190) in the variant of the present invention.

FIG. 109 is an amino acid sequence alignment between wild-type protein MI2B_HUMAN (SEQ ID NO:193) and the protein variant of the present invention, T11329_P2 (SEQ ID NO:192), described in Example 19 of the Examples section which follows, as determined using the Smith&Waterman model query db, with the following parameters: -mode=qglobal -onestrand -gapext=0-matrix=identity -out=g -gapop=40-dfmt=fastap. Note the presence of a unique amino acid sequence (marked in yellow; SEQ ID NO:88) in the variant of the present invention.

FIG. 110 is an amino acid sequence alignment between wild-type protein VEGA_HUMAN (SEQ ID NO:196) and the protein variant of the present invention, HUMEGFAA_P6 (SEQ ID NO:195), described in Example 23 of the Examples section which follows, as determined using the Smith&Waterman model query db, with the following parameters: -mode=qglobal -onestrand -gapext=0- matrix=identity -out=g -gapop=40-dfmt=fastap. Note the absence of a amino acid sequence (marked in yellow; SEQ ID NO:197) in the variant of the present invention.

FIG. 111 is an amino acid sequence alignment between wild-type protein VEGA_HUMAN (SEQ ID NO:196) and the protein variant of the present invention, HUMEGFAA_P8 (SEQ ID NO:199), described in Example 23 of the Examples section which follows, as determined using the Smith&Waterman model query db, with the following parameters: -mode=qglobal -onestrand -gapext=0- matrix=identity -out=g -gapop=40-dfmt=fastap. Note the absence of amino acid sequence (marked in yellow; SEQ ID NO:200) in the variant of the present invention.

FIG. 112 is an amino acid sequence alignment between wild-type protein IL1R_HUMAN (SEQ ID NO:203) and the protein variant of the present invention, HUMIL1RA_P3 (SEQ ID NO:202), described in Example 24 of the Examples section which follows, as determined using the Smith&Waterman model query db, with the following parameters: -mode=qglobal -onestrand -gapext=0- matrix=identity -out=g -gapop=40-dfmt=fastap. Note the presence of a unique amino acid sequence (marked in yellow; SEQ ID NO:204) in the variant of the present invention.

FIG. 113 is an amino acid sequence alignment between wild-type protein CR1_HUMAN_V4 (SEQ ID NO:260) and the protein variant of the present invention, HSCR1RS_PEA__1_P13 (SEQ ID NO:261), described in Example 25 of the Examples section which follows, as determined using the Smith&Waterman model query db, with the following parameters: -mode=qglobal -onestrand -gapext=0 -matrix=identity -out=g -gapop=40-dfmt=fastap.

FIG. 114 is an amino acid sequence alignment between wild-type protein CR1_HUMAN (SEQ ID NO:148) and the protein variant of the present invention, HSCR1RS_PEA__1_P14 (SEQ ID NO:262), described in Example 25 of the Examples section which follows, as determined using the Smith&Waterman model query db, with the following parameters: -mode=qglobal -onestrand -gapext=0- matrix=identity -out=g -gapop=40-dfmt=fastap.

FIG. 115 is an amino acid sequence alignment between wild-type protein CR1_HUMAN (SEQ ID NO:148) and the protein variant of the present invention, HSCR1RS_PEA__1_P15 (SEQ ID NO:263), described in Example 25 of the Examples section which follows, as determined using the Smith&Waterman model query db, with the following parameters: -mode=qglobal -onestrand -gapext=0- matrix=identity -out=g -gapop=40-dfmt=fastap.

FIG. 116 is an amino acid sequence alignment between wild-type protein CR1_HUMAN_V1 (SEQ ID NO:259) and the protein variant of the present invention, HSCR1RS_PEA__1_P17 (SEQ ID NO:264), described in Example 25 of the Examples section which follows, as determined using the Smith&Waterman model query db, with the following parameters: -mode=qglobal -onestrand -gapext=0 -matrix=identity -out=g -gapop=40-dfmt=fastap.

FIG. 117 is an amino acid sequence alignment between wild-type protein IL1B_HUMAN (SEQ ID NO:265) and the protein variant of the present invention, HSPROI1B_X1 (SEQ ID NO:270), described in Example 27 of the Examples section which follows, as determined using the Smith&Waterman model query db, with the following parameters: -mode=qglobal -onestrand -gapext=0- matrix=identity -out=g -gapop=40-dfmt=fastap. Note the presence of a unique amino acid sequence (marked in yellow; SEQ ID NO: 266) in the variant of the present invention.

FIG. 118 is an amino acid sequence alignment between wild-type protein PGDR_HUMAN (SEQ ID NO:267) and the protein variant of the present invention, HUMPDGFR_P6 (SEQ ID NO:272), described in Example 30 of the Examples section which follows, as determined using the Smith&Waterman model query db, with the following parameters: -mode=qglobal -onestrand -gapext=0- matrix=identity -out=g -gapop=40-dfmt=fastap. Note the presence of a unique amino acid sequence (marked in yellow; SEQ ID NO:268) in the variant of the present invention.

FIG. 119 is an amino acid sequence alignment between wild-type protein EL3B_HUMAN (SEQ ID NO:328) and the protein variant of the present invention, HUMPRE_P4 (SEQ ID NO:274), described in Example 34 of the Examples section which follows, as determined using the Smith&Waterman model query db, with the following parameters: -mode=qglobal -onestrand -gapext=0- matrix=identity -out=g -gapop=40-dfmt=fastap. Note the presence of a unique amino acid sequence (marked in yellow; SEQ ID NO:329) in the variant of the present invention.

FIG. 120 is an amino acid sequence alignment between wild-type protein SOMA_HUMAN (SEQ ID NO:640) and the protein variant of the present invention, HSGROW1_P11 (SEQ ID NO:276), described in Example 36 of the Examples section which follows, as determined using the Smith&Waterman model query db, with the following parameters: -mode=qglobal -onestrand -gapext=0- matrix=identity -out=g -gapop=40-dfmt=fastap.

FIG. 121 is an amino acid sequence alignment between wild-type protein (CSH_HUMAN; SEQ ID NO:330) and the protein variant of the present invention, HUMCS2_P3 (SEQ ID NO:278), described in Example 37 of the Examples section which follows, as determined using the Smith&Waterman model query db, with the following parameters: -mode=qglobal -onestrand -gapext=0- matrix=identity -out=g -gapop=40-dfmt=fastap. Note the presence of a unique amino acid sequence (marked in yellow; SEQ ID NO:331) in the variant of the present invention.

FIG. 122 is an amino acid sequence alignment between wild-type protein (CSH_HUMAN—SEQ ID NO:330) and the protein variant of the present invention, HUMCS2_P9 (SEQ ID NO:280), described in Example 37 of the Examples section which follows, as determined using the Smith&Waterman model query db, with the following parameters: -mode=qglobal -onestrand -gapext=0- matrix=identity -out=g -gapop=40-dfmt=fastap. Note the presence of a unique amino acid sequence (marked in yellow; SEQ ID NO:641) in the variant of the present invention.

FIG. 123 is an amino acid sequence alignment between wild-type FINC_HUMAN (SEQ ID NO:644) and the protein variant of the present invention, HUMFNC_P54 (SEQ ID NO:282), described in Example 38 of the Examples section which follows, as determined using the Smith&Waterman model query db, with the following parameters: -mode=qglobal -onestrand -gapext=0-matrix=identity -out=g -gapop=40-dfmt=fastap. Note the presence of a unique amino acid sequence (marked in yellow; SEQ ID NO:645) in the variant of the present invention.

FIG. 124 is an amino acid sequence alignment between wild-type ITA8_HUMAN 9SEQ ID NO:327) and the protein variant of the present invention, M85929_P3 (SEQ ID NO:284), described in Example 39 of the Examples section which follows, as determined using the Smith&Waterman model query db, with the following parameters: -mode=qglobal -onestrand -gapext=0-matrix=identity -out=g -gapop=40-dfmt=fastap. Note the presence of R (marked in yellow) in the variant of the present invention.

FIG. 125 is an amino acid sequence alignment between wild-type IBP3_HUMAN (SEQ ID NO:647) and the protein variant of the present invention, S56205_P7 (SEQ ID NO:285), described in Example 43 of the Examples section which follows, as determined using the Smith&Waterman model query db, with the following parameters: -mode=qglobal -onestrand -gapext=0-matrix=identity -out=g -gapop=40-dfmt=fastap. Note the presence of a unique amino acid sequence (marked in yellow; SEQ ID NO:659) in the variant of the present invention.

FIG. 126 is an amino acid sequence alignment between wild-type IBP3_HUMAN (SEQ ID NO:647) and the protein variant of the present invention, S56205_P15 (SEQ ID NO:287), described in Example 43 of the Examples section which follows, as determined using the Smith&Waterman model query db, with the following parameters: -mode=qglobal -onestrand -gapext=0-matrix=identity -out=g -gapop=40-dfmt=fastap. Note the presence of a unique amino acid sequence (marked in yellow; SEQ ID NO:660) in the variant of the present invention.

FIG. 127 is an amino acid sequence alignment between wild-type RNBP_HUMAN (SEQ ID NO:648) and the protein variant of the present invention, HUMREBP_P2 (SEQ ID NO:289), described in Example 44 of the Examples section which follows, as determined using the Smith&Waterman model query db, with the following parameters: -mode=qglobal -onestrand -gapext=0- matrix=identity -out=g -gapop=40-dfmt=fastap. Note the presence of a unique amino acid sequence (marked in yellow; SEQ ID NO:661) in the variant of the present invention.

FIG. 128 is an amino acid sequence alignment between wild-type RNBP_HUMAN (SEQ ID NO:648) and the protein variant of the present invention, HUMREBP_Skippingexon_10_P (SEQ ID NO:291), described in Example 44 of the Examples section which follows, as determined using the Smith&Waterman model query db, with the following parameters: -mode=qglobal -onestrand -gapext=0 -matrix=identity -out=g -gapop=40-dfmt=fastap. Note the presence of a unique amino acid sequence (marked in yellow; SEQ ID NO:662) in the variant of the present invention.

FIG. 129 is an amino acid sequence alignment between wild-type RNBP_HUMAN (SEQ ID NO:648) and the protein variant of the present invention, HUMREBP_P3 (SEQ ID NO:293), described in Example 44 of the Examples section which follows, as determined using the Smith&Waterman model query db, with the following parameters: -mode=qglobal -onestrand -gapext=0- matrix=identity -out=g -gapop=40-dfmt=fastap. Note the presence of a unique amino acid sequence (marked in yellow; SEQ ID NO:663) in the variant of the present invention.

FIG. 130 is an amino acid sequence alignment between wild-type RNBP_HUMAN (SEQ ID NO:648) and the protein variant of the present invention, HUMREBP_P4 (SEQ ID NO:295), described in Example 44 of the Examples section which follows, as determined using the Smith&Waterman model query db, with the following parameters: -mode=qglobal -onestrand -gapext=0- matrix=identity -out=g -gapop=40-dfmt=fastap. Note the absence of amino acid sequence (marked in yellow) in the variant of the present invention.

FIG. 131 is an amino acid sequence alignment between wild-type RNBP_HUMAN (SEQ ID NO:648) and the protein variant of the present invention, HUMREBP_P1 (SEQ ID NO:297), described in Example 44 of the Examples section which follows, as determined using the Smith&Waterman model query db, with the following parameters: -mode=qglobal -onestrand -gapext=0- matrix=identity -out=g -gapop=40-dfmt=fastap. Note the presence of a unique amino acid sequence (marked in yellow; SEQ ID NO:664) in the variant of the present invention.

FIG. 132 is an amino acid sequence alignment between wild-type HGF_HUMAN (SEQ ID NO:649) and the protein variant of the present invention, HSHGFR_Skipping_exon_ 3_P (SEQ ID NO:299), described in Example 45 of the Examples section which follows, as determined using the Smith&Waterman model query db, with the following parameters: -mode=qglobal -onestrand -gapext=0 -matrix=identity -out=g -gapop=40-dfmt=fastap. Note the presence of a unique amino acid sequence LH (marked in yellow;) in the variant of the present invention.

FIG. 133 is an amino acid sequence alignment between wild-type HGF_HUMAN (SEQ ID NO:649) and the protein variant of the present invention, HSHGFR_Skipping_exon_ 4_P (SEQ ID NO:301), described in Example 45 of the Examples section which follows, as determined using the Smith&Waterman model query db, with the following parameters: -mode=qglobal -onestrand -gapext=0 -matrix=identity -out=g -gapop=40-dfmt=fastap. Note the presence of a unique amino acid sequence (marked in yellow; SEQ ID NO:665) in the variant of the present invention.

FIG. 134 is an amino acid sequence alignment between wild-type HGF_HUMAN (SEQ ID NO:649) and the protein variant of the present invention, HSHGFR_Skipping_exon_ 7_P (SEQ ID NO:303), described in Example 45 of the Examples section which follows, as determined using the Smith&Waterman model query db, with the following parameters: -mode=qglobal -onestrand -gapext=0 -matrix=identity -out=g -gapop=40-dfmt=fastap. Note the presence of a unique amino acid S (marked in yellow) in the variant of the present invention.

FIG. 135 is an amino acid sequence alignment between wild-type HGF_HUMAN (SEQ ID NO:649) and the protein variant of the present invention, HSHGFR_Skipping_exon_ 9_P (SEQ ID NO:305), described in Example 45 of the Examples section which follows, as determined using the Smith&Waterman model query db, with the following parameters: -mode=qglobal -onestrand -gapext=0 -matrix=identity -out=g -gapop=40-dfmt=fastap. Note the presence of a unique amino acid sequence (marked in yellow; SEQ ID NO:666) in the variant of the present invention.

FIG. 136 is an amino acid sequence alignment between wild-type CART_HUMAN (SEQ ID NO:650) and the protein variant of the present invention, HSU16826_Skippingexon_2_P (SEQ ID NO:307) described in Example 46 of the Examples section which follows, as determined using the Smith&Waterman model query db, with the following parameters: -mode=qglobal -onestrand -gapext=0 -matrix=identity -out=g -gapop=40-dfmt=fastap. Note the absence of amino acid sequence (marked in yellow) in the variant of the present invention.

FIG. 137 is an amino acid sequence alignment between wild-type DPP4_HUMAN (SEQ ID NO:651) and the protein variant of the present invention, HSPCHDP7_Skippingexon_7_P (SEQ ID NO:309), described in Example 47 of the Examples section which follows, as determined using the Smith&Waterman model query db, with the following parameters: -mode=qglobal -onestrand -gapext=0 -matrix=identity -out=g -gapop=40- dfmt=fastap. Note the presence of a unique amino acid sequence (marked in yellow; SEQ ID NO:667) in the variant of the present invention.

FIG. 138 is an amino acid sequence alignment between wild-type DPP4_HUMAN (SEQ ID NO:651) and the protein variant of the present invention, HSPCHDP7_Skippingexon_9_P (SEQ ID NO:311), described in Example 47 of the Examples section which follows, as determined using the Smith&Waterman model query db, with the following parameters: -mode=qglobal -onestrand -gapext=0 -matrix=identity -out=g -gapop=40- dfmt=fastap. Note the presence of a unique amino acid sequence (marked in yellow; SEQ ID NO:668) in the variant of the present invention.

FIG. 139 is an amino acid sequence alignment between wild-type DPP4_HUMAN (SEQ ID NO:651) and the protein variant of the present invention, HSPCHDP7_Skippingexon_19_P (SEQ ID NO:313), described in Example 47 of the Examples section which follows, as determined using the Smith&Waterman model query db, with the following parameters: -mode=qglobal -onestrand -gapext=0 -matrix=identity -out=g -gapop=40- dfmt=fastap. Note the presence of a unique amino acid sequence (marked in yellow; SEQ ID NO:669) in the variant of the present invention.

FIG. 140 is an amino acid sequence alignment between wild-type DPP4_HUMAN (SEQ ID NO:651) and the protein variant of the present invention, HSPCHDP7_Skippingexon_21_P (SEQ ID NO:315), described in Example 47 of the Examples section which follows, as determined using the Smith&Waterman model query db, with the following parameters: -mode=qglobal -onestrand -gapext=0 -matrix=identity -out=g -gapop=40- dfmt=fastap. Note the presence of a unique amino acid sequence (marked in yellow; SEQ ID NO:670) in the variant of the present invention.

FIG. 141 is an amino acid sequence alignment between wild-type DPP4_HUMAN SEQ ID NO:651 and the protein variant of the present invention, HSPCHDP_Skippingexon_ 22_P (SEQ ID NO:317), described in Example 47 of the Examples section which follows, as determined using the Smith&Waterman model query db, with the following parameters: -mode=qglobal -onestrand -gapext=0 -matrix=identity -out=g -gapop=40-dfmt=fastap. Note the unique amino acid sequence (marked in yellow; SEQ ID NO:671) in the variant of the present invention.

FIG. 142 is an amino acid sequence alignment between wild-type DPP4_HUMAN (SEQ ID NO:651) and the protein variant of the present invention, HSPCHDP7_Skippingexon_24_P (SEQ ID NO:319), described in Example 47 of the Examples section which follows, as determined using the Smith&Waterman model query db, with the following parameters: -mode=qglobal -onestrand -gapext=0 -matrix=identity -out=g -gapop=40- dfmt=fastap. Note the unique amino acid sequence (marked in yellow; SEQ ID NO:672) in the variant of the present invention.

FIG. 143 is an amino acid sequence alignment between wild-type DPP4_HUMAN (SEQ ID NO:651) and the protein variant of the present invention, HSPCHDP7_Skippingexon_25_P (SEQ ID NO:321), described in Example 47 of the Examples section which follows, as determined using the Smith&Waterman model query db, with the following parameters: -mode=qglobal -onestrand -gapext=0 -matrix=identity -out=g -gapop=40-dfmt=fastap. Note the unique amino acid sequence (marked in yellow; SEQ ID NO:673) in the variant of the present invention.

FIG. 144 is an amino acid sequence alignment between wild-type DPP4_HUMAN (SEQ ID NO:651) and the protein variant of the present invention, HSPCHDP7_skippingexon_24_25_P (SEQ ID NO:323), described in Example 47 of the Examples section which follows, as determined using the Smith&Waterman model query db, with the following parameters: -mode=qglobal -onestrand -gapext=0 -matrix=identity -out=g -gapop=40-dfmt=fastap. Note the missing amino acid sequence (marked in yellow) in the variant of the present invention.

FIG. 145 is an amino acid sequence alignment between wild-type TFPI_HUMAN (SEQ ID NO:366) and the protein variant of the present invention, D12020_P5 (SEQ ID NO:367), described in Example 10 of the Examples section which follows, as determined using the Smith&Waterman model query db, with the following parameters: -mode=qglobal -onestrand -gapext=0-matrix=identity -out=g -gapop=40-dfmt=fastap.

FIG. 146 is an amino acid sequence alignment between wild-type TFPI_HUMAN (SEQ ID NO:366) and the protein variant of the present invention, D12020_P10 (SEQ ID NO:368), described in Example 10 of the Examples section which follows, as determined using the Smith&Waterman model query db, with the following parameters: -mode=qglobal -onestrand -gapext=0-matrix=identity -out=g -gapop=40-dfmt=fastap.

FIG. 147 is an amino acid sequence alignment between wild-type TFPI_HUMAN (SEQ ID NO:366) and the protein variant of the present invention, D12020_P11 (SEQ ID NO:369), described in Example 10 of the Examples section which follows, as determined using the Smith&Waterman model query db, with the following parameters: -mode=qglobal -onestrand -gapext=0-matrix=identity -out=g -gapop=40-dfmt=fastap.

FIG. 148 is an amino acid sequence alignment between wild-type EGFR_HUMAN(SEQ ID NO:427) and the protein variant of the present invention, HSEGF01_PEA_1_P11 (SEQ ID NO:423), described in Example 42 of the Examples section which follows, as determined using the Smith&Waterman model query db, with the following parameters: -mode=qglobal -onestrand -gapext=0- matrix=identity -out=g -gapop=40-dfmt=fastap.

FIG. 149 is an amino acid sequence alignment between wild-type EGFR_HUMAN (SEQ ID NO:427) and the protein variant of the present invention, HSEGF01_PEA_1_P14 (SEQ ID NO:424), described in Example 42 of the Examples section which follows, as determined using the Smith&Waterman model query db, with the following parameters: -mode=qglobal -onestrand -gapext=0- matrix=identity -out=g -gapop=40-dfmt=fastap.

FIG. 150 is an amino acid sequence alignment between wild-type EGFR_HUMAN (SEQ ID NO:427) and the protein variant of the present invention, HSEGF01_PEA_1_P18 (SEQ ID NO:425), described in Example 42 of the Examples section which follows, as determined using the Smith&Waterman model query db, with the following parameters: -mode=qglobal -onestrand -gapext=0- matrix=identity -out=g -gapop=40-dfmt=fastap.

FIG. 151 is an amino acid sequence alignment between wild-type EGFR_HUMAN (SEQ ID NO:427) and the protein variant of the present invention, HSEGF01_PEA_1_P24 (SEQ ID NO:426), described in Example 42 of the Examples section which follows, as determined using the Smith&Waterman model query db, with the following parameters: -mode=qglobal -onestrand -gapext=0- matrix=identity -out=g -gapop=40-dfmt=fastap.

FIG. 152 is an amino acid sequence alignment between wild-type VEGA_HUMAN (SEQ ID NO:196) and the protein variant of the present invention, HUMEGFAA_PEA_2_P3 (SEQ ID NO:495), described in Example 49 of the Examples section which follows, as determined using the Smith&Waterman model query db, with the following parameters: -mode=qglobal -onestrand -gapext=0 -matrix=identity -out=g -gapop=40-dfmt=fastap.

FIG. 153 is an amino acid sequence alignment between wild-type VEGA_HUMAN (SEQ ID NO:196) and the protein variant of the present invention, HUMEGFAA_PEA_2_P14 (SEQ ID NO:496), described in Example 49 of the Examples section which follows, as determined using the Smith&Waterman model query db, with the following parameters: -mode=qglobal -onestrand -gapext=0 -matrix=identity -out=g -gapop=40-dfmt=fastap.

FIG. 154 is an amino acid sequence alignment between wild-type VGR1_HUMAN (SEQ ID NO:530) and the protein variant of the present invention, HSFLT_PEA_1_P3 (SEQ ID NO:531), described in Example 50 of the Examples section which follows, as determined using the Smith&Waterman model query db, with the following parameters: -mode=qglobal -onestrand -gapext=0- matrix=identity -out=g -gapop=40-dfmt=fastap.

FIG. 155 is an amino acid sequence alignment between wild-type VGR1_HUMAN (SEQ ID NO:530) and the protein variant of the present invention, HSFLT_PEA_1_P4 (SEQ ID NO:532), described in Example 50 of the Examples section which follows, as determined using the Smith&Waterman model query db, with the following parameters: -mode=qglobal -onestrand -gapext=0- matrix=identity -out=g -gapop=40-dfmt=fastap.

FIG. 156 is an amino acid sequence alignment between wild-type VGR1_HUMAN (SEQ ID NO:530) and the protein variant of the present invention, HSFLT_PEA_1_P10 (SEQ ID NO:533), described in Example 50 of the Examples section which follows, as determined using the Smith&Waterman model query db, with the following parameters: -mode=qglobal -onestrand -gapext=0- matrix=identity -out=g -gapop=40-dfmt=fastap.

FIG. 157 is an amino acid sequence alignment between wild-type VGR1_HUMAN (SEQ ID NO:530) and the protein variant of the present invention, HSFLT_PEA_1_P12 (SEQ ID NO:534), described in Example 50 of the Examples section which follows, as determined using the Smith&Waterman model query db, with the following parameters: -mode=qglobal -onestrand -gapext=0- matrix=identity -out=g -gapop=40-dfmt=fastap.

FIG. 158 is an amino acid sequence alignment between wild-type VGR1_HUMAN (SEQ ID NO:530) and the protein variant of the present invention, HSFLT_PEA_1_P13 (SEQ ID NO:535), described in Example 50 of the Examples section which follows, as determined using the Smith&Waterman model query db, with the following parameters: -mode=qglobal -onestrand -gapext=0- matrix=identity -out=g -gapop=40-dfmt=fastap.

FIG. 159 is an amino acid sequence alignment between wild-type VGR1_HUMAN (SEQ ID NO:530) and the protein variant of the present invention, HSFLT_PEA_1_P14 (SEQ ID NO:536), described in Example 50 of the Examples section which follows, as determined using the Smith&Waterman model query db, with the following parameters: -mode=qglobal -onestrand -gapext=0- matrix=identity -out=g -gapop=40-dfmt=fastap.

FIG. 160 is an amino acid sequence alignment between wild-type VGR1_HUMAN (SEQ ID NO:530) and the protein variant of the present invention, HSFLT_PEA_1_P19 (SEQ ID NO:537), described in Example 50 of the Examples section which follows, as determined using the Smith&Waterman model query db, with the following parameters: -mode=qglobal -onestrand -gapext=0- matrix=identity -out=g -gapop=40-dfmt=fastap.

FIG. 161 is an amino acid sequence alignment between wild-type VGR2_HUMAN (SEQ ID NO:555) and the protein variant of the present invention, HUMKDRZ_P8 (SEQ ID NO:556), described in Example 51 of the Examples section which follows, as determined using the Smith&Waterman model query db, with the following parameters: -mode=qglobal -onestrand -gapext=0- matrix=identity -out=g -gapop=40-dfmt=fastap.

FIG. 162 is an amino acid sequence alignment between wild-type VGR2_HUMAN (SEQ ID NO:555) and the protein variant of the present invention, HUMKDRZ_P9 (SEQ ID NO:557), described in Example 51 of the Examples section which follows, as determined using the Smith&Waterman model query db, with the following parameters: -mode=qglobal -onestrand -gapext=0- matrix=identity -out=g -gapop=40-dfmt=fastap.

FIG. 163 is an amino acid sequence alignment between wild-type CTL4_HUMAN (SEQ ID NO:564) and the protein variant of the present invention, HUMCTLA4B_PEA_1_P3 (SEQ ID NO:565), described in Example 52 of the Examples section which follows, as determined using the Smith&Waterman model query db, with the following parameters: -mode=qglobal -onestrand -gapext=0 -matrix=identity -out=g -gapop=40-dfmt=fastap.

FIG. 164 is an amino acid sequence alignment between wild-type TR1A_HUMAN (SEQ ID NO:631) and the protein variant of the present invention, HSTNFR1A_PEA_1_P11 (SEQ ID NO:632), described in Example 53 of the Examples section which follows, as determined using the Smith&Waterman model query db, with the following parameters: -mode=qglobal -onestrand -gapext=0 -matrix=identity -out=g -gapop=40-dfmt=fastap.

FIG. 165 is an amino acid sequence alignment between wild-type TR1A_HUMAN (SEQ ID NO:631) and the protein variant of the present invention, HSTNFR1A_PEA_1_P15 (SEQ ID NO:633), described in Example 53 of the Examples section which follows, as determined using the Smith&Waterman model query db, with the following parameters: -mode=qglobal -onestrand -gapext=0 -matrix=identity -out=g -gapop=40-dfmt=fastap.

FIG. 166 is an amino acid sequence alignment between wild-type TR1A_HUMAN (SEQ ID NO:631) and the protein variant of the present invention, HSTNFR1A_PEA_1_P19 (SEQ ID NO:634), described in Example 53 of the Examples section which follows, as determined using the Smith&Waterman model query db, with the following parameters: -mode=qglobal -onestrand -gapext=0 -matrix=identity -out=g -gapop=40-dfmt=fastap.

FIG. 167 is an amino acid sequence alignment between wild-type TR1A_HUMAN (SEQ ID NO:631) and the protein variant of the present invention, HSTNFR1A_PEA_1_P20 (SEQ ID NO:635), described in Example 53 of the Examples section which follows, as determined using the Smith&Waterman model query db, with the following parameters: -mode=qglobal -onestrand -gapext=0 -matrix=identity -out=g -gapop=40-dfmt=fastap.

FIG. 168 is an amino acid sequence alignment between wild-type TR1A_HUMAN (SEQ ID NO:631) and the protein variant of the present invention, HSTNFR1A_PEA_1_P22 (SEQ ID NO:636), described in Example 53 of the Examples section which follows, as determined using the Smith&Waterman model query db, with the following parameters: -mode=qglobal -onestrand -gapext=0 -matrix=identity -out=g -gapop=40-dfmt=fastap.

FIG. 169 is an amino acid sequence alignment between wild-type TR1A_HUMAN (SEQ ID NO:631) and the protein variant of the present invention, HSTNFR1A_PEA_1_P23 (SEQ ID NO:637), described in Example 53 of the Examples section which follows, as determined using the Smith&Waterman model query db, with the following parameters: -mode=qglobal -onestrand -gapext=0 -matrix=identity -out=g -gapop=40-dfmt=fastap.

FIG. 170 is an amino acid sequence alignment between wild-type TR1A_HUMAN (SEQ ID NO:631) and the protein variant of the present invention, HSTNFR1A_PEA_1_P24 (SEQ ID NO:638), described in Example 53 of the Examples section which follows, as determined using the Smith&Waterman model query db, with the following parameters: -mode=qglobal -onestrand -gapext=0 -matrix=identity -out=g -gapop=40-dfmt=fastap.

FIG. 171 is an amino acid sequence alignment between wild-type TR1A_HUMAN (SEQ ID NO:631) and the protein variant of the present invention, HSTNFR1A_PEA_1_P28 (SEQ ID NO:639), described in Example 53 of the Examples section which follows, as determined using the Smith&Waterman model query db, with the following parameters: -mode=qglobal -onestrand -gapext=0 -matrix=identity -out=g -gapop=40-dfmt=fastap.

FIG. 172 is an amino acid sequence alignment between wild-type CO5_HUMAN_V1 (SEQ ID NO:730) and the protein variant of the present invention, HUMC5_PEA_3_P12 (SEQ ID NO:727, described in Example 54 of the Examples section which follows, as determined using the Smith&Waterman model query db, with the following parameters: -mode=qglobal -onestrand -gapext=0 -matrix=identity -out=g -gapop=40-dfmt=fastap.

FIG. 173 is an amino acid sequence alignment between wild-type CO5_HUMAN (SEQ ID NO:730) and the protein variant of the present invention, HUMC5_PEA_3_P13 (SEQ ID NO:728), described in Example 54 of the Examples section which follows, as determined using the Smith&Waterman model query db, with the following parameters: -mode=qglobal -onestrand -gapext=0- matrix=identity -out=g -gapop=40-dfmt=fastap.

FIG. 174 is an amino acid sequence alignment between wild-type CO5_HUMAN (SEQ ID NO:730) and the protein variant of the present invention, HUMC5_PEA_3_P15 (SEQ ID NO:729), described in Example 54 of the Examples section which follows, as determined using the Smith&Waterman model query db, with the following parameters: -mode=qglobal -onestrand -gapext=0- matrix=identity -out=g -gapop=40-dfmt=fastap.

FIG. 175 is an amino acid sequence alignment between wild-type FA8_HUMAN (SEQ ID NO:769) and the protein variant of the present invention, HUMFVIII_PEA_1_P9 (SEQ ID NO:765), described in Example 55 of the Examples section which follows, as determined using the Smith&Waterman model query db, with the following parameters: -mode=qglobal -onestrand -gapext=0- matrix=identity -out=g -gapop=40-dfmt=fastap.

FIG. 176 is an amino acid sequence alignment between wild-type FA8_HUMAN (SEQ ID NO:769) and the protein variant of the present invention, HUMFVIII_PEA_1_P10

(SEQ ID NO:766), described in Example 55 of the Examples section which follows, as determined using the Smith&Waterman model query db, with the following parameters: -mode=qglobal -onestrand -gapext=0 -matrix=identity -out=g -gapop=40-dfmt=fastap.

FIG. 177 is an amino acid sequence alignment between wild-type FA8_HUMAN (SEQ ID NO:768) and the protein variant of the present invention, HUMFVIII_PEA_1_P11 (SEQ ID NO:767), described in Example 55 of the Examples section which follows, as determined using the Smith&Waterman model query db, with the following parameters: -mode=qglobal -onestrand -gapext=0 -matrix=identity -out=g -gapop=40-dfmt=fastap.

FIG. 178 is an amino acid sequence alignment between wild-type FA8_HUMAN (SEQ ID NO:769) and the protein variant of the present invention, HUMFVIII_PEA_1_P13 (SEQ ID NO:768), described in Example 55 of the Examples section which follows, as determined using the Smith&Waterman model query db, with the following parameters: -mode=qglobal -onestrand -gapext=0 -matrix=identity -out=g -gapop=40-dfmt=fastap.

FIG. 179 is an amino acid sequence alignment between wild-type C1S_HUMAN (SEQ ID NO:821) and the protein variant of the present invention, HUMC1RS_PEA_1_P8 (SEQ ID NO:816), described in Example 56 of the Examples section which follows, as determined using the Smith&Waterman model query db, with the following parameters: -mode=qglobal -onestrand -gapext=0- matrix=identity -out=g -gapop=40-dfmt=fastap.

FIG. 180 is an amino acid sequence alignment between wild-type C1S_HUMAN (SEQ ID NO:821) and the protein variant of the present invention, HUMC1RS_PEA_1_P21 (SEQ ID NO:817), described in Example 56 of the Examples section which follows, as determined using the Smith&Waterman model query db, with the following parameters: -mode=qglobal -onestrand -gapext=0 -matrix=identity -out=g -gapop=40-dfmt=fastap.

FIG. 181 is an amino acid sequence alignment between wild-type C1S_HUMAN (SEQ ID NO:821) and the protein variant of the present invention, HUMC1RS_PEA_1_P22 (SEQ ID NO:818), described in Example 56 of the Examples section which follows, as determined using the Smith&Waterman model query db, with the following parameters: -mode=qglobal -onestrand -gapext=0 -matrix=identity -out=g -gapop=40-dfmt=fastap.

FIG. 182 is an amino acid sequence alignment between wild-type C1S_HUMAN (SEQ ID NO:821) and the protein variant of the present invention, HUMC1RS_PEA_1_P23 (SEQ ID NO:819), described in Example 56 of the Examples section which follows, as determined using the Smith&Waterman model query db, with the following parameters: -mode=qglobal -onestrand -gapext=0 -matrix=identity -out=g -gapop=40-dfmt=fastap.

FIG. 183 is an amino acid sequence alignment between wild-type C1S_HUMAN (SEQ ID NO:821) and the protein variant of the present invention, HUMC1RS_PEA_1_P24 (SEQ ID NO:820), described in Example 56 of the Examples section which follows, as determined using the Smith&Waterman model query db, with the following parameters: -mode=qglobal -onestrand -gapext=0 -matrix=identity -out=g -gapop=40-dfmt=fastap.

FIG. 184 is an amino acid sequence alignment between wild-type SOMA_HUMAN (SEQ ID NO:850) and the protein variant of the present invention, HSGROW1_PEA_1_P7 (SEQ ID NO:851), described in Example 57 of the Examples section which follows, as determined using the Smith&Waterman model query db, with the following parameters: -mode=qglobal -onestrand -gapext=0- matrix=identity -out=g -gapop=40-dfmt=fastap.

FIG. 185 is an amino acid sequence alignment between wild-type SOMA_HUMAN (SEQ ID NO:850) and the protein variant of the present invention, HSGROW1_PEA_1_P11 (SEQ ID NO:852), described in Example 57 of the Examples section which follows, as determined using the Smith&Waterman model query db, with the following parameters: -mode=qglobal -onestrand -gapext=0 -matrix=identity -out=g -gapop=40-dfmt=fastap.

FIG. 186 is an amino acid sequence alignment between wild-type SOMA_HUMAN (SEQ ID NO:850) and the protein variant of the present invention, HSGROW1_PEA_1_P12 (SEQ ID NO:853), described in Example 57 of the Examples section which follows, as determined using the Smith&Waterman model query db, with the following parameters: -mode=qglobal -onestrand -gapext=0 -matrix=identity -out=g -gapop=40-dfmt=fastap.

FIG. 187 is an amino acid sequence alignment between wild-type SOMA_HUMAN (SEQ ID NO:850) and the protein variant of the present invention, HSGROW1_PEA_1_P18 (SEQ ID NO:854), described in Example 57 of the Examples section which follows, as determined using the Smith&Waterman model query db, with the following parameters: -mode=qglobal -onestrand -gapext=0 -matrix=identity -out=g -gapop=40-dfmt=fastap.

FIG. 188 is an amino acid sequence alignment between wild-type SOMA_HUMAN (SEQ ID NO:850) and the protein variant of the present invention, HSGROW1_PEA_1_P21 (SEQ ID NO:855), described in Example 57 of the Examples section which follows, as determined using the Smith&Waterman model query db, with the following parameters: -mode=qglobal -onestrand -gapext=0 -matrix=identity -out=g -gapop=40-dfmt=fastap.

FIG. 189 depicts the variants domain structure in comparison to the known or wild-type (WT) protein. T11 contains the convertase binding site on the β-chain (and maybe other, not yet know, binding sites), and thus, might interfere with the binding of the convertase with the WT C5, and might serve as an antagonist. T16, T14 might compete with C5 on its interaction with C5 convertase, and may thus serve as an antagonist of complement activation.

FIG. 190 depicts factor VIII launched products.

FIG. 191 depicts factor VIII related development.

FIG. 192 depicts factor VIII clinical and preclinical developments.

Figure 193:
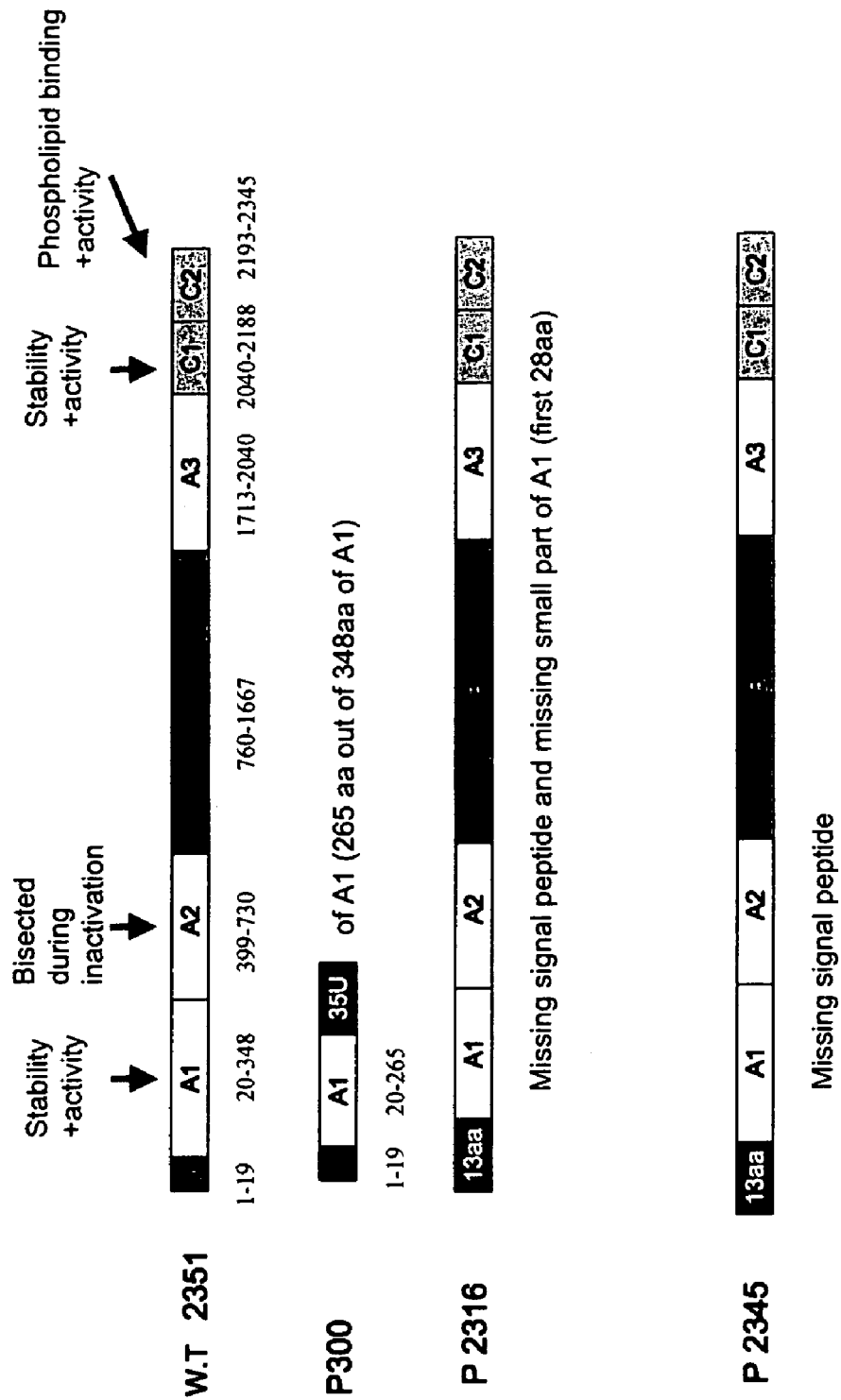

FIG. 193 depicts the domain structure of the variants described in Example 55 in comparison to the known or wild-type (WT) protein (Factor VIII).

Figures 1, 194:
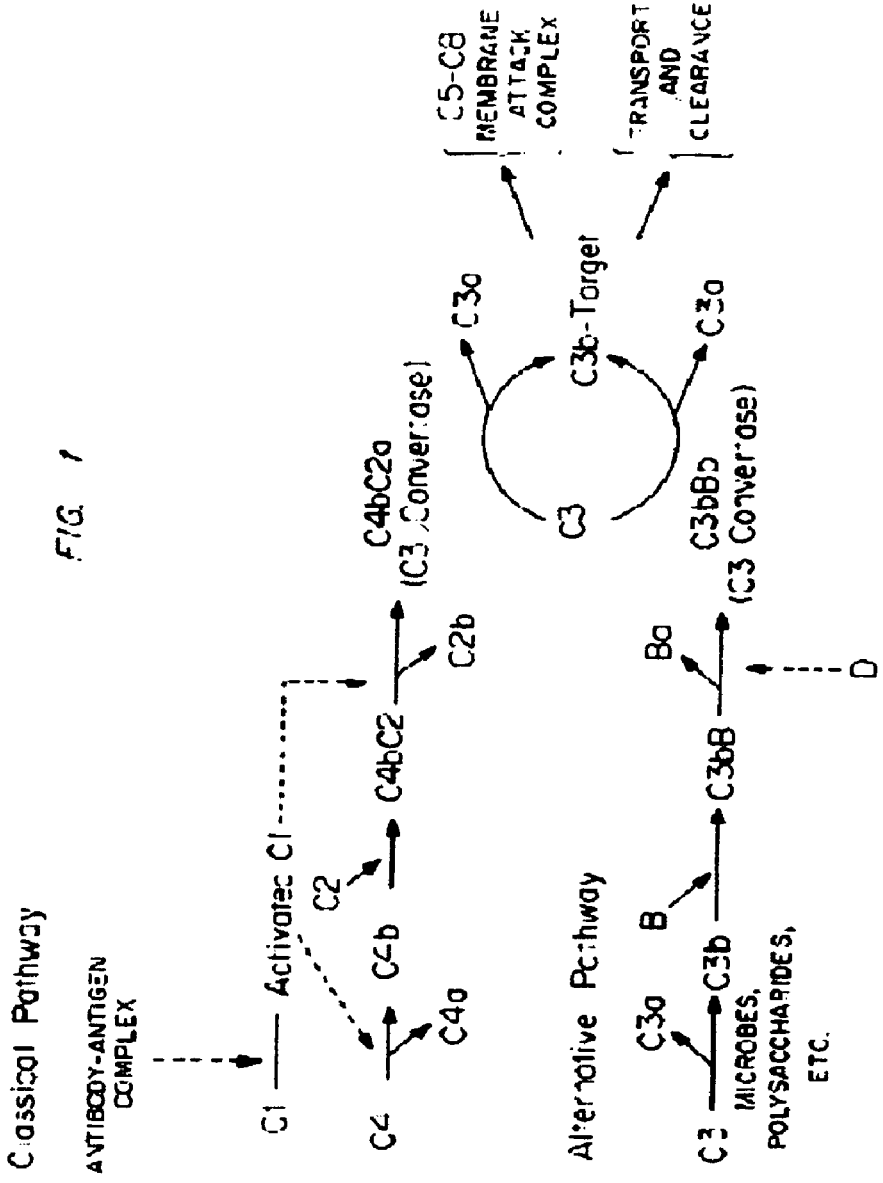
FIGS. 1a-b present the nucleic acid sequence (FIG. 1a) and amino acid sequence (FIG. 1b) of the GCSF variant of the present invention (SEQ ID NO:3 and 1, respectively), described in Example 2 of the Examples section which follows. The unique sequence is marked in bold and italics. The ATG and the stop codon are marked in bold and underlined.

FIG. 194 depicts the Complement Pathway, described in Example 56 of the Examples section which follows.

FIG. 195 depicts C5 clinical developments, described in Example 56 of the Examples section which follows.

FIG. 196 depicts C5 preclinical developments, described in Example 56 of the Examples section which follows.

FIG. 197 depicts CR1 clinical developments, described in Example 56 of the Examples section which follows.

FIGS. 198*a-b* depict the C1s clinical development (FIG. 198*a*) and related drugs (FIG. 198*b*), described in Example 56 of the Examples section which follows.

Figure 199:
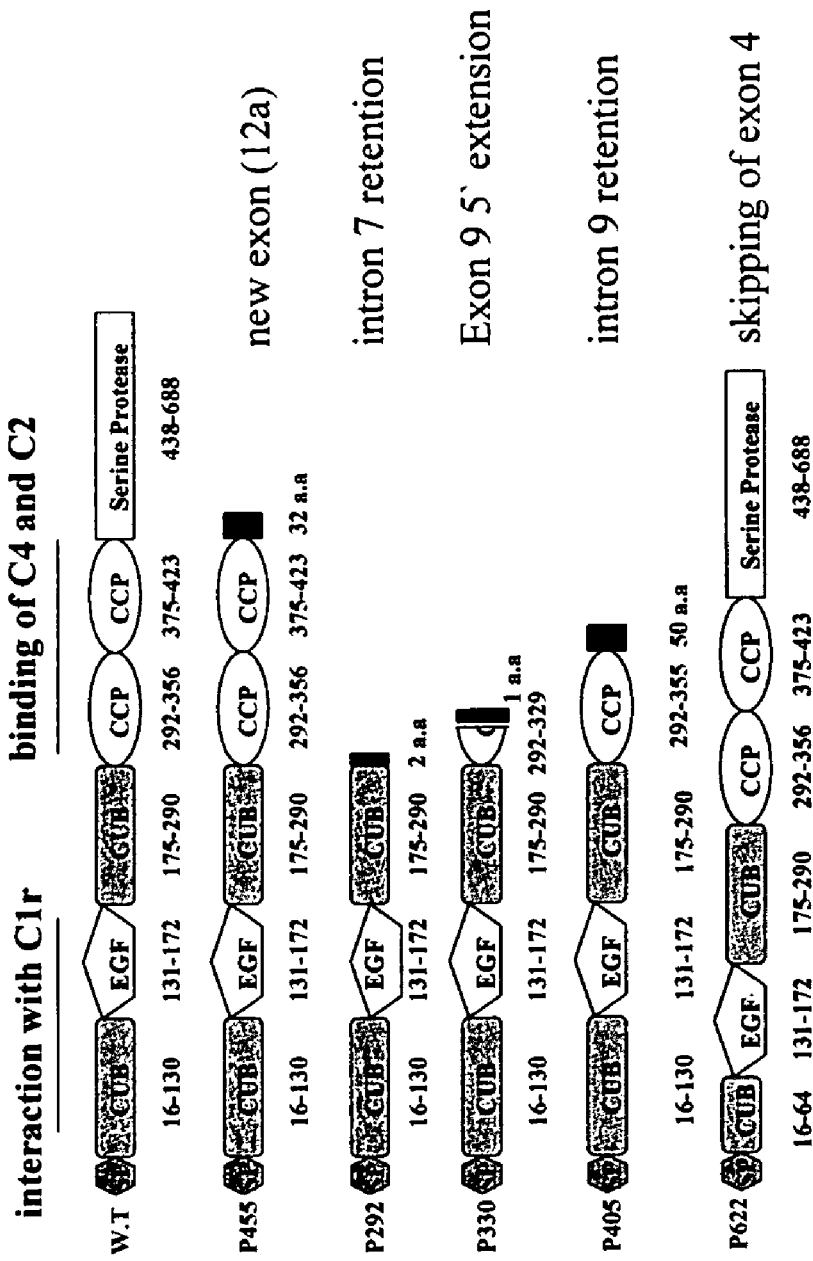

FIG. 199 depict the domain structure of the variants described in Example 56 compared to WT. P455 is predicted to be bound and cleaved by C1r, and to bind but not cleave, C4. P292, P330 and P405 are predicted to interact with C1r and to act as dominant negative. P621 will not be bound and cleaved by C1r, thus will not get activated however, it is predicted to retain its ability to bind C4 and thus, might serve as an antagonist.

FIG. 200 depicts GH antagonists-launched products, described in Example 57 of the Examples section which follows.

FIG. 201 depicts GH antagonists-clinical development, described in Example 57 of the Examples section which follows.

Figure 202:
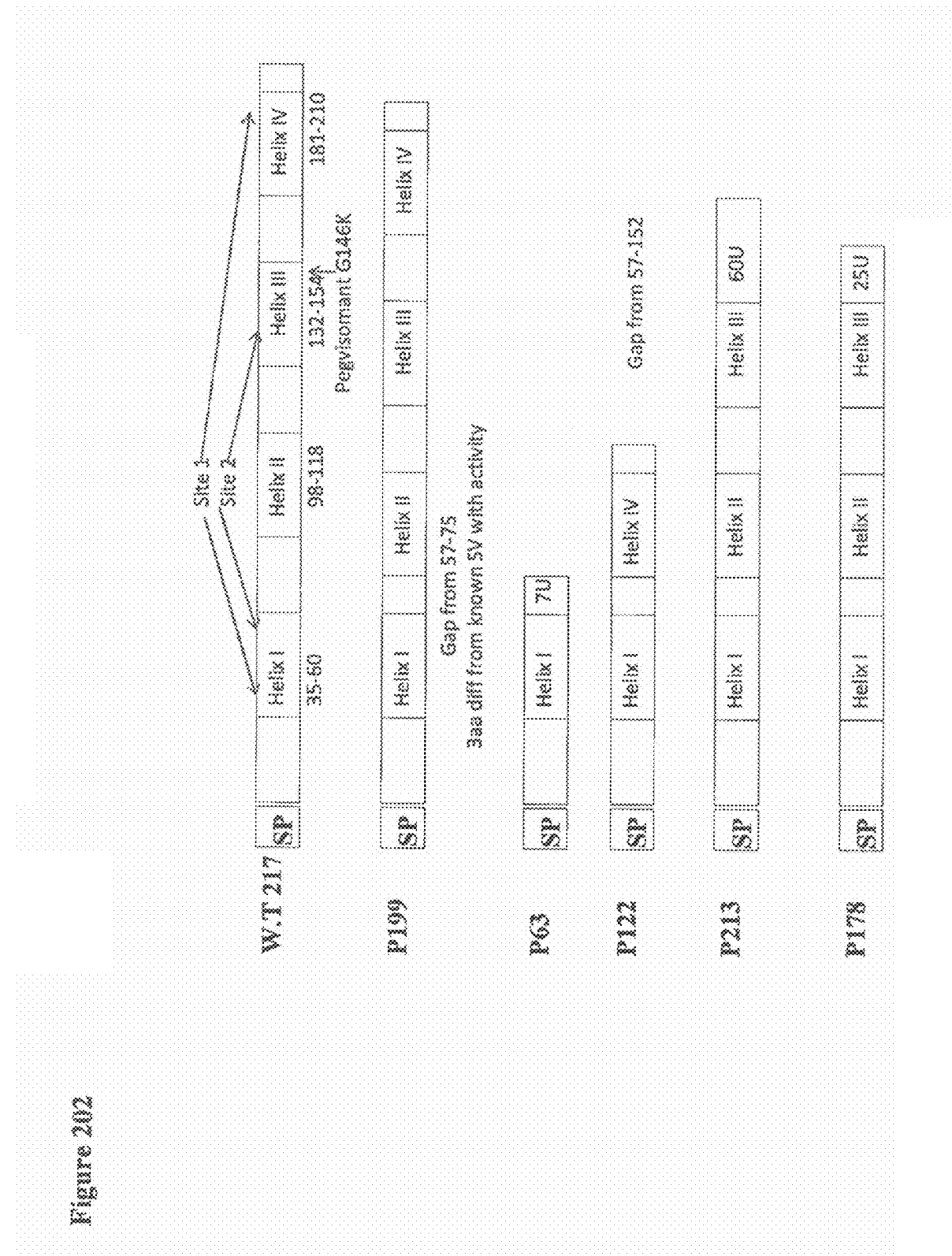

FIG. 202 depicts the domain structure of the variants described in Example 57 of the Examples section which follows, in comparison to WT.

FIG. 203 depicts the domain structure of the variants described in Example 51 of the Examples section which follows, in comparison to WT.

FIG. 204 depicts the domain structure of the variants described in Example 53 of the Examples section which follows, in comparison to WT.

FIG. 205 is an amino acid sequence alignment between wild-type PSPD_HUMAN (SEQ ID NO:858) and the protein variant of the present invention, D45608_P3 (SEQ ID NO:857), described in Example 58 of the Examples section which follows, as determined using the Smith&Waterman model query db, with the following parameters: -mode=qglobal -onestrand -gapext=0-matrix=identity -out=g -gapop=40-dfmt=fastap. Note the amino acid sequence which is missing in the D45608_P3 variant (marked in yellow).

FIG. 206 is an amino acid sequence alignment between wild-type TR1B_HUMAN (SEQ ID NO:862) and the protein variant of the present invention, HUMTNFRII_PEA_1_P7 (SEQ ID NO:696), described in Example 59 of the Examples section which follows, as determined using the Smith&Waterman model query db, with the following parameters: -mode=qglobal -onestrand -gapext=0 -matrix=identity -out=g -gapop=40-dfmt=fastap.

FIG. 207 is an amino acid sequence alignment between wild-type TR1B_HUMAN (SEQ ID NO:862) and the protein variant of the present invention, HUMTNFRII_PEA_1_P15 (SEQ ID NO:697), described in Example 59 of the Examples section which follows, as determined using the Smith&Waterman model query db, with the following parameters: -mode=qglobal -onestrand -gapext=0 -matrix=identity -out=g -gapop=40-dfmt=fastap.

FIG. 208 is an amino acid sequence alignment between wild-type TR1B_HUMAN (SEQ ID NO:862) and the protein variant of the present invention, HUMTNFRII_PEA_1_P17 (SEQ ID NO:699), described in Example 59 of the Examples section which follows, as determined using the Smith&Waterman model query db, with the following parameters: -mode=qglobal -onestrand -gapext=0 -matrix=identity -out=g -gapop=40-dfmt=fastap.

FIG. 209 is an amino acid sequence alignment between wild-type TR1B_HUMAN (SEQ ID NO:862) and the protein variant of the present invention, HUMTNFRII_PEA_1_P18 (SEQ ID NO:860), described in Example 59 of the Examples section which follows, as determined using the Smith&Waterman model query db, with the following parameters: -mode=qglobal -onestrand -gapext=0 -matrix=identity -out=g -gapop=40-dfmt=fastap.

FIG. 210 is an amino acid sequence alignment between wild-type TR1B_HUMAN (SEQ ID NO:862) and the protein variant of the present invention, HUMTNFRII_PEA_1_P19 (SEQ ID NO:861), described in Example 59 of the Examples section which follows, as determined using the Smith&Waterman model query db, with the following parameters: -mode=qglobal -onestrand -gapext=0 -matrix=identity -out=g -gapop=40-dfmt=fastap.

Figure 211:
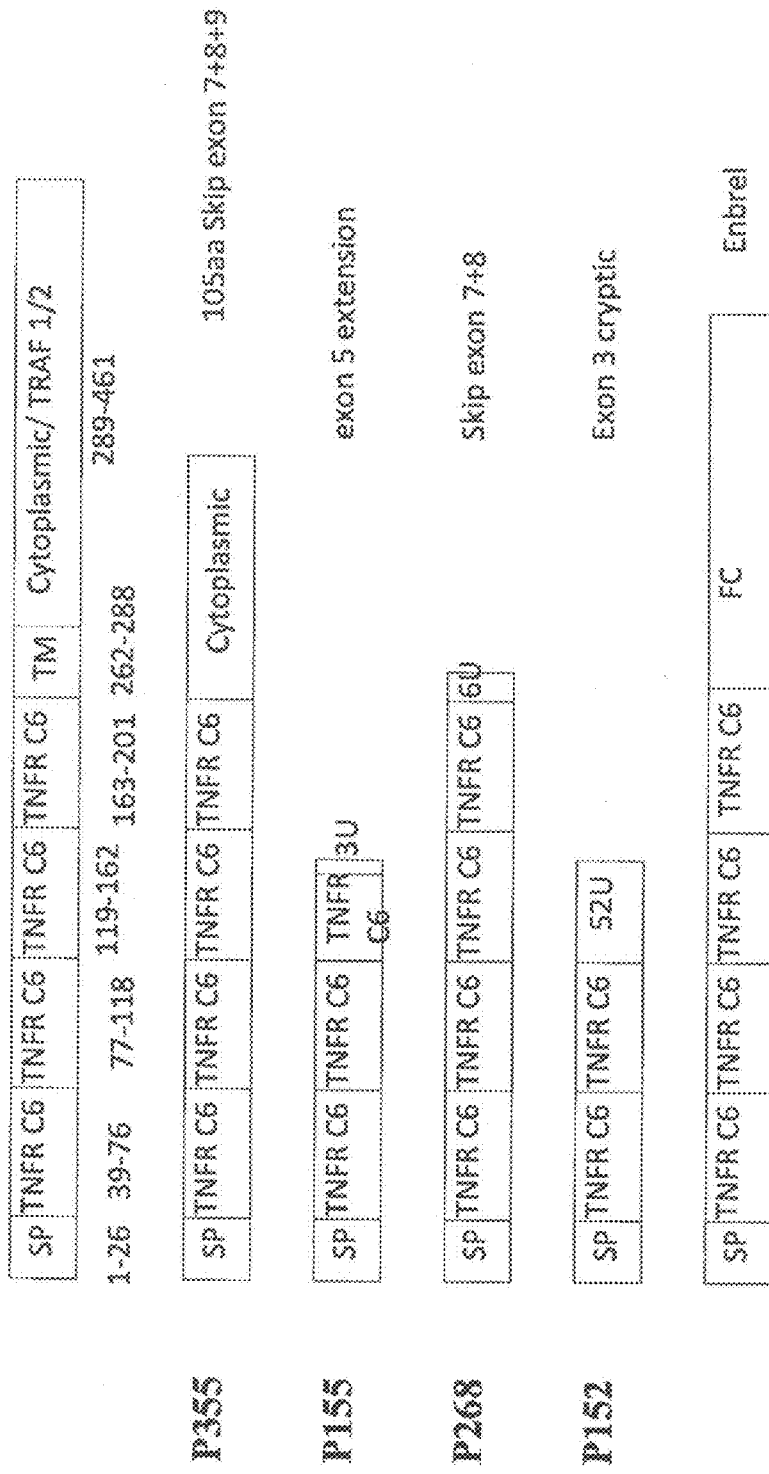

FIG. 211 depicts the domain structure of TNFRII variants in comparison to the known or wild-type (WT) protein, described in Example 59.

FIG. 212 depicts the clinical trials involve TNR3 lymphotoxin beta.

FIG. 213 is an amino acid sequence alignment between wild-type TNR3_HUMAN (SEQ ID NO:129) and the protein variant of the present invention, HUMTNFRRP_P2 (SEQ ID NO:898), described in Example 60 of the Examples section which follows, as determined using the Smith&Waterman model query db, with the following parameters: -mode=qglobal -onestrand -gapext=0-matrix=identity -out=g -gapop=40-dfmt=fastap.

FIG. 214 is an amino acid sequence alignment between wild-type TNR3_HUMAN (SEQ ID NO:129) and the protein variant of the present invention, HUMTNFRRP_P4 (SEQ ID NO:899), described in Example 60 of the Examples section which follows, as determined using the Smith&Waterman model query db, with the following parameters: -mode=qglobal -onestrand -gapext=0-matrix=identity -out=g -gapop=40-dfmt=fastap.

FIG. 215 is an amino acid sequence alignment between wild-type TNR3_HUMAN (SEQ ID NO:129) and the protein variant of the present invention, HUMTNFRRP_P9 (SEQ ID NO:900), described in Example 60 of the Examples section which follows, as determined using the Smith&Waterman model query db, with the following parameters: -mode=qglobal -onestrand -gapext=0-matrix=identity -out=g -gapop=40-dfmt=fastap.

FIG. 216 depicts the domain structure of the variants described in Example 60 of the Examples section which follows in comparison to WT TNR3_HUMAN (SEQ ID NO:129)

FIG. 217 depicts the IL-12 clinical developments.

FIG. 218 is an amino acid sequence alignment between wild-type I12A_HUMAN (SEQ ID NO:933) and the protein variant of the present invention, HUMCLMF35_PEA_1_PEA_2_P14 (SEQ ID NO:927), described in Example 61 of the Examples section which follows, as determined using the Smith&Waterman model query db, with the following parameters: -mode=qglobal -onestrand -gapext=0 -matrix=identity -out=g -gapop=40-dfmt=fastap.

FIG. 219 is an amino acid sequence alignment between wild-type I12A_HUMAN (SEQ ID NO:933) and the protein variant of the present invention, HUMCLMF35_PEA_1_PEA_2_P15 (SEQ ID NO:928), described in Example 61 of the Examples section which follows, as determined using the Smith&Waterman model query db, with the following parameters: -mode=qglobal -onestrand -gapext=0 -matrix=identity -out=g -gapop=40-dfmt=fastap.

FIG. 220 is an amino acid sequence alignment between wild-type I12A_HUMAN (SEQ ID NO:933) and the protein variant of the present invention, HUMCLMF35_PEA_1_PEA_2_P16 (SEQ ID NO:929), described in Example 61 of the Examples section which follows, as determined using the Smith&Waterman model query db, with the following parameters: -mode=qglobal -onestrand -gapext=0 -matrix=identity -out=g -gapop=40-dfmt=fastap.

FIG. 221 is an amino acid sequence alignment between wild-type I12A_HUMAN (SEQ ID NO:933) and the protein variant of the present invention, HUMCLMF35_PEA_1_PEA_2_P17 (SEQ ID NO:930), described in Example 61 of the Examples section which follows, as determined using the Smith&Waterman model query db, with the following parameters: -mode=qglobal -onestrand -gapext=0 -matrix=identity -out=g -gapop=40-dfmt=fastap.

FIG. 222 is an amino acid sequence alignment between wild-type I12A_HUMAN (SEQ ID NO:933) and the protein variant of the present invention, HUMCLMF35_PEA_1_PEA_2_P20 (SEQ ID NO:931), described in Example 61 of the Examples section which follows, as determined using the Smith&Waterman model query db, with the following parameters: -mode=qglobal -onestrand -gapext=0 -matrix=identity -out=g -gapop=40-dfmt=fastap.

FIG. 223 is an amino acid sequence alignment between wild-type I12A_HUMAN (SEQ ID NO:933) and the protein variant of the present invention, HUMCLMF35_PEA_1_PEA_2_P22 (SEQ ID NO:932), described in Example 61 of the Examples section which follows, as determined using the Smith&Waterman model query db, with the following parameters: -mode=qglobal -onestrand -gapext=0 -matrix=identity -out=g -gapop=40-dfmt=fastap.

FIG. 224 depicts the domain structure of the variants described in Example 61 of the Example section which follows in comparison with the WT IL12.

FIG. 225 depicts the IL6 clinical developments.

Figure 226:
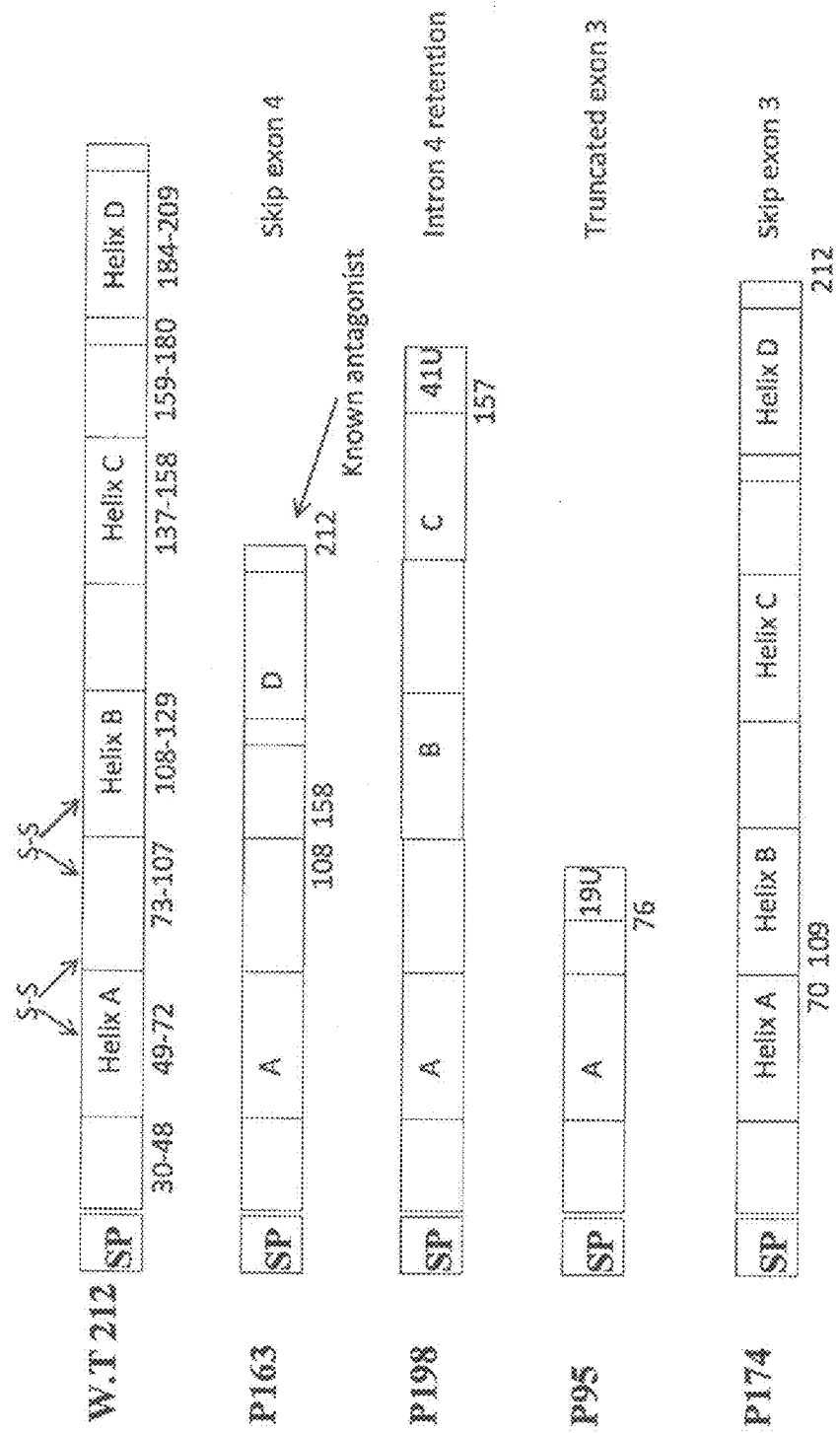

FIG. 226 depicts the domain structure of the variants described in Example 62 of the Examples section which follows in comparison to WT IL6.

FIG. 227 is an amino acid sequence alignment between wild-type IL6_HUMAN (SEQ ID NO:959) and the protein variant of the present invention, S56892_PEA_1_PEA_1_P8 (SEQ ID NO:956), described in Example 62 of the Examples section which follows, as determined using the Smith&Waterman model query db, with the following parameters: -mode=qglobal -onestrand -gapext=0 -matrix=identity -out=g -gapop=40-dfmt=fastap.

FIG. 228 is an amino acid sequence alignment between wild-type IL6_HUMAN (SEQ ID NO:959) and the protein variant of the present invention, S56892_PEA_1_PEA_1_P9 (SEQ ID NO:957), described in Example 62 of the Examples section which follows, as determined using the Smith&Waterman model query db, with the following parameters: -mode=qglobal -onestrand -gapext=0 -matrix=identity -out=g -gapop=40-dfmt=fastap.

FIG. 229 is an amino acid sequence alignment between wild-type IL6_HUMAN (SEQ ID NO:959) and the protein variant of the present invention, S56892_PEA_1_PEA_1_P11 (SEQ ID NO:958), described in Example 62 of the Examples section which follows, as determined using the Smith&Waterman model query db, with the following parameters: -mode=qglobal -onestrand -gapext=0 -matrix=identity -out=g -gapop=40-dfmt=fastap.

FIG. 230 is an amino acid sequence alignment between wild-type TGR2_HUMAN (SEQ ID NO:974) and the protein variant of the present invention, HUMTGFBIIR_PEA_1_P9 (SEQ ID NO:972), described in Example 63 of the Examples section which follows, as determined using the Smith&Waterman model query db, with the following parameters: -mode=qglobal -onestrand -gapext=0 -matrix=identity -out=g -gapop=40-dfmt=fastap.

FIG. 231 is an amino acid sequence alignment between wild-type TGR2_HUMAN (SEQ ID NO:974) and the protein variant of the present invention, HUMTGFBIIR_PEA_1_P14 (SEQ ID NO:973), described in Example 63 of the Examples section which follows, as determined using the Smith&Waterman model query db, with the following parameters: -mode=qglobal -onestrand -gapext=0 -matrix=identity -out=g -gapop=40-dfmt=fastap.

FIG. 232 depicts the domain structure of the variants described in Example 63 of the Examples section which follows in comparison to TGR2_HUMAN variant.

FIG. 233 depicts GCSF launched products, described in Example 64 of the Examples section which follows.

FIG. 234 depicts GCSF clinical developments described in Example 64 of the Examples section which follows.

FIG. 235 depicts GCSF Preclinical developments described in Example 64 of the Examples section which follows.

FIG. 236 depicts GCSF domain structure of the variants described in Example 64 of the Examples section which follows, in comparison to WT GCSF.

FIG. 237 is an amino acid sequence alignment between wild-type CSF3_HUMAN (SEQ ID NO:128) and the protein variant of the present invention, HUMGCSF_PEA_1_P5 (SEQ ID NO:1000), described in Example 64 of the Examples section which follows, as determined using the Smith&Waterman model query db, with the following parameters: -mode=qglobal -onestrand -gapext=0 -matrix=identity -out=g -gapop=40-dfmt=fastap.

FIG. 238 is an amino acid sequence alignment between wild-type CSF3_HUMAN (SEQ ID NO:128) and the protein variant of the present invention, HUMGCSF_PEA_1_P6 (SEQ ID NO:1001), described in Example 64 of the Examples section which follows, as determined using the Smith&Waterman model query db, with the following parameters: -mode=qglobal -onestrand -gapext=0 -matrix=identity -out=g -gapop=40-dfmt=fastap.

FIG. 239 is an amino acid sequence alignment between wild-type CSF3_HUMAN (SEQ ID NO:128) and the protein variant of the present invention, HUMGCSF_PEA_1_P7 (SEQ ID NO:1002), described in Example 64 of the Examples section which follows, as determined using the Smith&Waterman model query db, with the following parameters: -mode=qglobal -onestrand -gapext=0 -matrix=identity -out=g -gapop=40-dfmt=fastap.

FIG. 240 is an amino acid sequence alignment between wild-type CSF3_HUMAN (SEQ ID NO:128) and the protein variant of the present invention, HUMGCSF_PEA_1_P8 (SEQ ID NO:1003), described in Example 64 of the Examples section which follows, as determined using the Smith&Waterman model query db, with the following parameters: -mode=qglobal -onestrand -gapext=0 -matrix=identity -out=g -gapop=40-dfmt=fastap.

FIG. 241 is an amino acid sequence alignment between wild-type Q8N4W3 (SEQ ID NO:1012) and the protein variant of the present invention, HUMGCSF_PEA_1_P8 (SEQ ID NO:1003), described in Example 64 of the Examples section which follows, as determined using the Smith&Waterman model query db, with the following parameters: -mode=qglobal -onestrand -gapext=0 -matrix=identity -out=g -gapop=40-dfmt=fastap.

FIG. 242 is an amino acid sequence alignment between wild-type CSF3_HUMAN (SEQ ID NO:128) and the protein variant of the present invention, HUMGCSF_PEA_1_P9 (SEQ ID NO:1004), described in Example 64 of the Examples section which follows, as determined using the Smith&Waterman model query db, with the following parameters: -mode=qglobal -onestrand -gapext=0 -matrix=identity -out=g -gapop=40-dfmt=fastap.

FIG. 243 is an amino acid sequence alignment between wild-type CSF3_HUMAN (SEQ ID NO:128) and the protein variant of the present invention, HUMGCSF_PEA_1_P13 (SEQ ID NO:1005), described in Example 64 of the Examples section which follows, as determined using the Smith&Waterman model query db, with the following FIG. 244 is an amino acid sequence alignment between wild-type CSF3_HUMAN (SEQ ID NO:128) and the protein variant of the present invention, HUMGCSF_PEA_1_P14 (SEQ ID NO:1006), described in Example 64 of the Examples section which follows, as determined using the Smith&Waterman model query db, with the following parameters: -mode=qglobal -onestrand -gapext=0 -matrix=identity -out=g -gapop=40-dfmt=fastap.

FIG. 245 is an amino acid sequence alignment between Q8N4W3 (SEQ ID NO:1012) and the protein variant of the present invention, HUMGCSF_PEA_1_P14 (SEQ ID NO:1006), described in Example 64 of the Examples section which follows, as determined using the Smith&Waterman model query db, with the following parameters: -mode=qglobal -onestrand -gapext=0-matrix=identity -out=g -gapop=40 -dfmt=fastap.

FIG. 246 is an amino acid sequence alignment between wild-type CSF3_HUMAN (SEQ ID NO:128) and the protein variant of the present invention, HUMGCSF_PEA_1_P16 (SEQ ID NO:1007), described in Example 64 of the Examples section which follows, as determined using the Smith&Waterman model query db, with the following parameters: -mode=qglobal -onestrand -gapext=0 -matrix=identity -out=g -gapop=40-dfmt=fastap.

FIG. 247 is an amino acid sequence alignment between wild-type CSF3_HUMAN (SEQ ID NO:128) and the protein variant of the present invention, HUMGCSF_PEA_1_P18 (SEQ ID NO:1008), described in Example 64 of the Examples section which follows, as determined using the Smith&Waterman model query db, with the following parameters: -mode=qglobal -onestrand -gapext=0 -matrix=identity -out=g -gapop=40-dfmt=fastap.

FIG. 248 is an amino acid sequence alignment between wild-type CSF3_HUMAN (SEQ ID NO:128) and the protein variant of the present invention, HUMGCSF_PEA_1_P19 (SEQ ID NO:1009), described in Example 64 of the Examples section which follows, as determined using the Smith&Waterman model query db, with the following parameters: -mode=qglobal -onestrand -gapext=0 -matrix=identity -out=g -gapop=40-dfmt=fastap.

FIG. 249 is an amino acid sequence alignment between wild-type CSF3_HUMAN (SEQ ID NO:128) and the protein variant of the present invention, HUMGCSF_PEA_1_P20 (SEQ ID NO:1010), described in Example 64 of the Examples section which follows, as determined using the Smith&Waterman model query db, with the following parameters: -mode=qglobal -onestrand -gapext=0 -matrix=identity -out=g -gapop=40-dfmt=fastap.

FIG. 250 is an amino acid sequence alignment between Q8N4W3 (SEQ ID NO:1012) and the protein variant of the present invention, HUMGCSF_PEA_1_P20 (SEQ ID NO:1010), described in Example 64 of the Examples section which follows, as determined using the Smith&Waterman model query db, with the following parameters: -mode=qglobal -onestrand -gapext=0-matrix=identity -out=g -gapop=40 -dfmt=fastap.

FIG. 251 is an amino acid sequence alignment between wild-type CSF3_HUMAN (SEQ ID NO:128) and the protein variant of the present invention, HUMGCSF_PEA_1_P21 (SEQ ID NO:1011), described in Example 64 of the Examples section which follows, as determined using the Smith&Waterman model query db, with the following parameters: -mode=qglobal -onestrand -gapext=0 -matrix=identity -out=g -gapop=40-dfmt=fastap.

FIG. 252 depicts the TGF beta clinical studies described in Example 65 of the Examples section which follows.

FIG. 253 depicts TGF beta preclinical studies described in Example 65 of the Examples section which follows.

FIG. 254 depicts domain structure of the variants described in Example 65 of the Examples section which follows in comparison to WT TGF-beta.

FIG. 255 is an amino acid sequence alignment between wild-type TGF1_HUMAN (SEQ ID NO:1048) and the protein variant of the present invention, HSTGFB1_PEA_1_P2 (SEQ ID NO:1043), described in Example 65 of the Examples section which follows, as determined using the Smith&Waterman model query db, with the following parameters: -mode=qglobal -onestrand -gapext=0-matrix=identity -out=g -gapop=40-dfmt=fastap.

FIG. 256 is an amino acid sequence alignment between wild-type TGF1_HUMAN (SEQ ID NO:1048) and the protein variant of the present invention, HSTGFB1_PEA_1_P3 (SEQ ID NO:1044), described in Example 65 of the Examples section which follows, as determined using the Smith&Waterman model query db, with the following parameters: -mode=qglobal -onestrand -gapext=0-matrix=identity -out=g -gapop=40-dfmt=fastap.

FIG. 257 is an amino acid sequence alignment between wild-type TGF1_HUMAN (SEQ ID NO:1048) and the protein variant of the present invention, HSTGFB1_PEA_1_P5 (SEQ ID NO:1045), described in Example 65 of the Examples section which follows, as determined using the Smith&Waterman model query db, with the following parameters: -mode=qglobal -onestrand -gapext=0-matrix=identity -out=g -gapop=40-dfmt=fastap.

FIG. 258 is an amino acid sequence alignment between wild-type TGF1_HUMAN (SEQ ID NO:1048) and the protein variant of the present invention, HSTGFB1_PEA_1_P7 (SEQ ID NO:1046), described in Example 65 of the Examples section which follows, as determined using the Smith&Waterman model query db, with the following parameters: -mode=qglobal -onestrand -gapext=0-matrix=identity -out=g -gapop=40-dfmt=fastap.

FIG. 259 is an amino acid sequence alignment between wild-type TGF1_HUMAN (SEQ ID NO:1048) and the protein variant of the present invention, HSTGFB1_PEA_1_P10 (SEQ ID NO:1047), described in Example 65 of the Examples section which follows, as determined using the Smith&Waterman model query db, with the following parameters: -mode=qglobal -onestrand -gapext=0 -matrix=identity -out=g -gapop=40-dfmt=fastap.

FIG. 260 is an amino acid sequence alignment between wild-type TPA_HUMAN (SEQ ID NO:150) and the protein variant of the present invention, HUMUPAA_P14 (SEQ ID NO:1102), described in Example 66 of the Examples section which follows, as determined using the Smith&Waterman model query db, with the following parameters: -mode=qglobal -onestrand -gapext=0-matrix=identity -out=g -gapop=40-dfmt=fastap.

FIG. 261 is an amino acid sequence alignment between wild-type TPA_HUMAN (SEQ ID NO:150) and the protein variant of the present invention, HUMUPAA_P17 (SEQ ID NO:1103), described in Example 66 of the Examples section which follows, as determined using the Smith&Waterman model query db, with the following parameters: -mode=qglobal -onestrand -gapext=0-matrix=identity -out=g -gapop=40-dfmt=fastap.

FIG. 262 is an amino acid sequence alignment between wild-type TPA_HUMAN (SEQ ID NO:150) and the protein variant of the present invention, HUMUPAA_P20 (SEQ ID NO:1104), described in Example 66 of the Examples section which follows, as determined using the Smith&Waterman model query db, with the following parameters: -mode=qglobal -onestrand -gapext=0-matrix=identity -out=g -gapop=40-dfmt=fastap.

Figure 263:
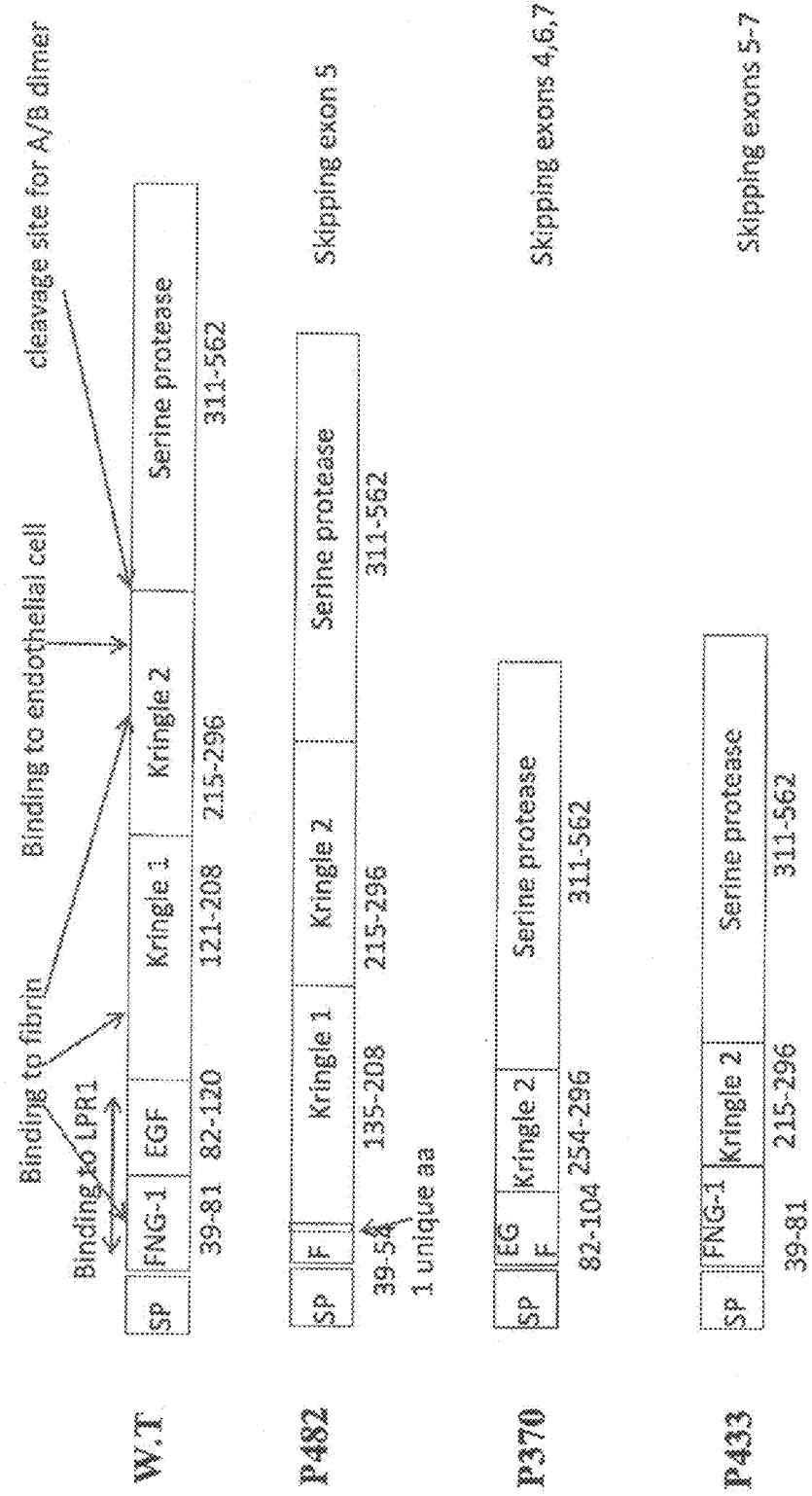

FIG. 263 depicts the domain structure of the variants described in Example 66 of the Examples section which follows in comparison to the WT TPA_HUMAN.

FIG. 264 is an amino acid sequence alignment between wild-type DRN1_HUMAN (SEQ ID NO:1131) and the protein variant of the present invention, HUMDNASEI_PEA_1_P3 (SEQ ID NO:1127), described in Example 67 of the Examples section which follows, as determined using the Smith&Waterman model query db, with the following parameters: -mode=qglobal -onestrand -gapext=0 -matrix=identity -out=g -gapop=40-dfmt=fastap.

FIG. 265 is an amino acid sequence alignment between wild-type DRN1_HUMAN (SEQ ID NO:1131) and the protein variant of the present invention, HUMDNASEI_PEA_1_P4 (SEQ ID NO:1128), described in Example 67 of the Examples section which follows, as determined using the Smith&Waterman model query db, with the following parameters: -mode=qglobal -onestrand -gapext=0 -matrix=identity -out=g -gapop=40-dfmt=fastap.

FIG. 266 is an amino acid sequence alignment between wild-type DRN1_HUMAN (SEQ ID NO:1131) and the protein variant of the present invention, HUMDNASEI_PEA_1_P6 (SEQ ID NO:1129), described in Example 67 of the Examples section which follows, as determined using the Smith&Waterman model query db, with the following parameters: -mode=qglobal -onestrand -gapext=0 -matrix=identity -out=g -gapop=40-dfmt=fastap.

FIG. 267 is an amino acid sequence alignment between wild-type DRN1_HUMAN (SEQ ID NO:1131) and the protein variant of the present invention, HUMDNASEI_PEA_1_P10 (SEQ ID NO:1130), described in Example 67 of the Examples section which follows, as determined using the Smith&Waterman model query db, with the following parameters: -mode=qglobal -onestrand -gapext=0 -matrix=identity -out=g -gapop=40-dfmt=fastap.

FIG. 268 is an amino acid sequence alignment between wild-type TNFA_HUMAN (SEQ ID NO:1155) and the protein variant of the present invention, HUMTNFAA_PEA_1_P6 (SEQ ID NO:1144), described in Example 68 of the Examples section which follows, as determined using the Smith&Waterman model query db, with the following parameters: -mode=qglobal -onestrand -gapext=0 -matrix=identity -out=g -gapop=40-dfmt=fastap.

FIG. 269 is an amino acid sequence alignment between wild-type TNFA_HUMAN (SEQ ID NO:1155) and the protein variant of the present invention, HUMTNFAA_PEA_1_P7 (SEQ ID NO:1145), described in Example 68 of the Examples section which follows, as determined using the Smith&Waterman model query db, with the following parameters: -mode=qglobal -onestrand -gapext=0 -matrix=identity -out=g -gapop=40-dfmt=fastap.

FIG. 270 is an amino acid sequence alignment between wild-type TNFA_HUMAN_V1 (SEQ ID NO:1147) and the protein variant of the present invention, HUMTNFAA_PEA_1_P8 (SEQ ID NO:1146), described in Example 68 of the Examples section which follows, as determined using the Smith&Waterman model query db, with the following parameters: -mode=qglobal -onestrand -gapext=0 -matrix=identity -out=g -gapop=40-dfmt=fastap.

FIG. 271 is an amino acid sequence alignment between wild-type MEC2_HUMAN (SEQ ID NO:1154) and the protein variant of the present invention, M62144_P3 SEQ ID NO:1148), described in Example 69 of the Examples section which follows, as determined using the Smith&Waterman model query db, with the following parameters: -mode=qglobal -onestrand -gapext=0-matrix=identity -out=g -gapop=40-dfmt=fastap.

FIG. 272 is an amino acid sequence alignment between wild-type MEC2_HUMAN (SEQ ID NO:1154) and the protein variant of the present invention, M62144_P2 (SEQ ID NO:1150), described in Example 69 of the Examples section which follows, as determined using the Smith&Waterman model query db, with the following parameters: -mode=qglobal -onestrand -gapext=0-matrix=identity -out=g -gapop=40-dfmt=fastap.

FIG. 273 is an amino acid sequence alignment between wild-type MEC2_HUMAN (SEQ ID NO:1154) and the protein variant of the present invention, M62144_P4 (SEQ ID NO:1152), described in Example 69 of the Examples section which follows, as determined using the Smith&Waterman model query db, with the following parameters: -mode=qglobal -onestrand -gapext=0-matrix=identity -out=g -gapop=40-dfmt=fastap.

DESCRIPTION OF THE PREFERRED EMBODIMENTS

The present invention is of novel secreted and non-secreted polypeptides and polynucleotides encoding same, which can be used for the diagnosis and treatment of a wide range of diseases, such as cancer and inflammatory diseases.

According to still other preferred embodiments, the present invention optionally and preferably encompasses any amino acid sequence or fragment thereof encoded by a nucleic acid sequence corresponding to a splice variant protein as described herein, including any oligopeptide or peptide relating to such an amino acid sequence or fragment, including but not limited to the unique amino acid sequences of these proteins that are depicted as tails, heads, insertions, edges or bridges. The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to a splice variant of the present invention as described above, optionally for any application.

In another embodiment, the present invention relates to bridges, tails, heads and/or insertions, and/or analogs, homologs and derivatives of such peptides. Such bridges, tails, heads and/or insertions are described in greater detail below with regard to the Examples.

As used herein a "tail" refers to a peptide sequence at the end of an amino acid sequence that is unique to a splice variant according to the present invention. Therefore, a splice variant having such a tail may optionally be considered as a chimera, in that at least a first portion of the splice variant is typically highly homologous (often 100% identical) to a portion of the corresponding known protein, while at least a second portion of the variant comprises the tail.

As used herein a "head" refers to a peptide sequence at the beginning of an amino acid sequence that is unique to a splice variant according to the present invention. Therefore, a splice variant having such a head may optionally be considered as a chimera, in that at least a first portion of the splice variant comprises the head, while at least a second portion is typically highly homologous (often 100% identical) to a portion of the corresponding known protein.

As used herein "an edge portion" refers to a connection between two portions of a splice variant according to the present invention that were not joined in the wild type or known protein. An edge may optionally arise due to a join between the above "known protein" portion of a variant and the tail, for example, and/or may occur if an internal portion of the wild type sequence is no longer present, such that two portions of the sequence are now contiguous in the splice variant that were not contiguous in the known protein. A "bridge" may optionally be an edge portion as described above, but may also include a join between a head and a "known protein" portion of a variant, or a join between a tail and a "known protein" portion of a variant, or a join between an insertion and a "known protein" portion of a variant.

In another embodiment, this invention provides antibodies specifically recognizing the splice variants and polypeptide fragments thereof of this invention. Preferably such antibodies differentially recognize splice variants of the present invention but do not recognize a corresponding known protein (such known proteins are discussed with regard to their splice variants in the Examples below).

In another embodiment, this invention provides an isolated nucleic acid molecule encoding for a splice variant according to the present invention, having a nucleotide sequence as set forth in any one of the sequences listed herein, or a sequence complementary thereto. In another embodiment, this invention provides an isolated nucleic acid molecule, having a nucleotide sequence as set forth in any one of the sequences listed herein, or a sequence complementary thereto. In another embodiment, this invention provides an oligonucleotide of at least about 12 nucleotides, specifically hybridizable with the nucleic acid molecules of this invention. In another embodiment, this invention provides vectors, cells, liposomes and compositions comprising the isolated nucleic acids of this invention.

Nucleic Acid Sequences and Oligonucleotides

Various embodiments of the present invention encompass nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or artificially induced, either randomly or in a targeted fashion.

The present invention encompasses nucleic acid sequences described herein; fragments thereof, sequences hybridizable therewith, sequences homologous thereto [e.g., at least 50%, at least 55%, at least 60%, at least 65%, at least 70%, at least 75%, at least 80%, at least 85%, at least 95% or more say 100% identical to the nucleic acid sequences set forth below], sequences encoding similar polypeptides with different codon usage, altered sequences characterized by mutations, such as deletion, insertion or substitution of one or more nucleotides, either naturally occurring or man induced, either randomly or in a targeted fashion. The present invention also encompasses homologous nucleic acid sequences (i.e., which form a part of a polynucleotide sequence of the present invention) which include sequence regions unique to the polynucleotides of the present invention.

In cases where the polynucleotide sequences of the present invention encode previously unidentified polypeptides, the present invention also encompasses novel polypeptides or portions thereof, which are encoded by the isolated polynucleotide and respective nucleic acid fragments thereof described hereinabove.

Thus, the present invention provides isolated polynucleotides each encoding a polypeptide which is at least 50%, at least 55%, at least 60%, at least 65%, at least 70%, at least 75%, at least 80%, %, at least 85%, %, at least 90%, at least 95% or more, say 100% identical to a polypeptide sequence listed in the Examples section or sequence listing, as determined using the LALIGN software of EMBnet Switzerland using default parameters.

A "nucleic acid fragment" or an "oligonucleotide" or a "polynucleotide" are used herein interchangeably to refer to a polymer of nucleic acids. A polynucleotide sequence of the present invention refers to a single or double stranded nucleic acid sequences which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is composed of genomic and cDNA sequences. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Preferred embodiments of the present invention encompass oligonucleotide probes.

An example of an oligonucleotide probe which can be utilized by the present invention is a single stranded polynucleotide which includes a sequence complementary to the unique sequence region of any variant according to the present invention, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Alternatively, an oligonucleotide probe of the present invention can be designed to hybridize with a nucleic acid sequence encompassed by any of the above nucleic acid sequences, particularly the portions specified above, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Oligonucleotides designed according to the teachings of the present invention can be generated according to any oligonucleotide synthesis method known in the art such as enzymatic synthesis or solid phase synthesis. Equipment and reagents for executing solid-phase synthesis are commercially available from, for example, Applied Biosystems. Any other means for such synthesis may also be employed; the actual synthesis of the oligonucleotides is well within the capabilities of one skilled in the art and can be accomplished via established methodologies as detailed in, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988) and "Oligonucleotide Synthesis" Gait, M. J., ed. (1984) utilizing solid phase chemistry, e.g. cyanoethyl phosphoramidite followed by deprotection, desalting and purification by for example, an automated trityl-on method or HPLC.

Oligonucleotides used according to this aspect of the present invention are those having a length selected from a range of about 10 to about 200 bases preferably about 15 to about 150 bases, more preferably about 20 to about 100 bases, most preferably about 20 to about 50 bases. Preferably, the oligonucleotide of the present invention features at least 17, at least 18, at least 19, at least 20, at least 22, at least 25, at least 30 or at least 40, bases specifically hybridizable with the biomarkers of the present invention.

The oligonucleotides of the present invention may comprise heterocylic nucleosides consisting of purines and the pyrimidines bases, bonded in a 3' to 5' phosphodiester linkage.

Preferably used oligonucleotides are those modified at one or more of the backbone, internucleoside linkages or bases, as is broadly described hereinunder.

Specific examples of preferred oligonucleotides useful according to this aspect of the present invention include oligonucleotides containing modified backbones or non-natural internucleoside linkages. Oligonucleotides having modified backbones include those that retain a phosphorus atom in the backbone, as disclosed in U.S. Pat. Nos. 4,469,863; 4,476, 301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466, 677; 5,476,925; 5,519,126; 5,536,821; 5,541,306; 5,550,111; 5,563,253; 5,571,799; 5,587,361; and 5,625,050.

Preferred modified oligonucleotide backbones include, for example, phosphorothioates, chiral phosphorothioates, phosphorodithioates, phosphotriesters, aminoalkyl phosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free acid forms can also be used.

Alternatively, modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH2 component parts, as disclosed in U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439.

Other oligonucleotides which can be used according to the present invention, are those modified in both sugar and the internucleoside linkage, i.e., the backbone, of the nucleotide units are replaced with novel groups. The base units are maintained for complementation with the appropriate polynucleotide target. An example for such an oligonucleotide mimetic, includes peptide nucleic acid (PNA). United States patents that teach the preparation of PNA compounds include, but are not limited to, U.S. Pat. Nos. 5,539,082; 5,714,331; and 5,719,262, each of which is herein incorporated by reference. Other backbone modifications, which can be used in the present invention are disclosed in U.S. Pat. No. 6,303,374.

Oligonucleotides of the present invention may also include base modifications or substitutions. As used herein, "unmodified" or "natural" bases include the purine bases adenine (A) and guanine (G), and the pyrimidine bases thymine (T), cytosine (C) and uracil (U). Modified bases include but are not limited to other synthetic and natural bases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Further bases particularly useful for increasing the binding affinity of the oligomeric compounds of the invention include 5-substituted pyrimidines, 6-azapyrimidines and N-2, N-6 and O-6 substituted purines, including 2-aminopropyladenine, 5-propynyluracil and 5-propynylcytosine. 5-methylcytosine substitutions have been shown to increase nucleic acid duplex stability by 0.6-1.2° C. and are presently preferred base substitutions, even more particularly when combined with 2'-O-methoxyethyl sugar modifications.

Another modification of the oligonucleotides of the invention involves chemically linking to the oligonucleotide one or more moieties or conjugates, which enhance the activity, cellular distribution or cellular uptake of the oligonucleotide. Such moieties include but are not limited to lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxycholesterol moiety, as disclosed in U.S. Pat. No. 6,303,374.

It is not necessary for all positions in a given oligonucleotide molecule to be uniformly modified, and in fact more than one of the aforementioned modifications may be incorporated in a single compound or even at a single nucleoside within an oligonucleotide.

It will be appreciated that oligonucleotides of the present invention may include further modifications for more efficient use as diagnostic agents and/or to increase bioavailability, therapeutic efficacy and reduce cytotoxicity.

Expression of the Polynucleotide Sequence of the Present Invention

To enable cellular expression of the polynucleotides of the present invention, a nucleic acid construct (or an "expression vector") according to the present invention may be used, which includes at least a coding region of one of the above nucleic acid sequences, and further includes at least one cis acting regulatory element. As used herein, the phrase "cis acting regulatory element" refers to a polynucleotide sequence, preferably a promoter, which binds a trans acting regulator and regulates the transcription of a coding sequence located downstream thereto.

Eukaryotic promoters typically contain two types of recognition sequences, the TATA box and upstream promoter elements. The TATA box, located 25-30 base pairs upstream of the transcription initiation site, is thought to be involved in directing RNA polymerase to begin RNA synthesis. The other upstream promoter elements determine the rate at which transcription is initiated.

Preferably, the promoter utilized by the nucleic acid construct of the present invention is active in the specific cell population transformed. Examples of cell type-specific and/ or tissue-specific promoters include promoters such as albumin that is liver specific [Pinkert et al., (1987) Genes Dev. 1:268-277], lymphoid specific promoters [Calame et al., (1988) Adv. Immunol. 43:235-275]; in particular promoters of T-cell receptors [Winoto et al., (1989) EMBO J. 8:729-733] and immunoglobulins; [Banerji et al. (1983) Cell 33729-740], neuron-specific promoters such as the neurofilament promoter [Byrne et al. (1989) Proc. Natl. Acad. Sci. USA 86:5473-5477], pancreas-specific promoters [Edlunch et al. (1985) Science 230:912-916] or mammary gland-specific promoters such as the milk whey promoter (U.S. Pat. No. 4,873,316 and European Application Publication No. 264, 166). The nucleic acid construct of the present invention can further include an enhancer, which can be adjacent or distant to the promoter sequence and can function in up regulating the transcription therefrom.

Enhancer elements can stimulate transcription up to 1,000 fold from linked homologous or heterologous promoters. Enhancers are active when placed downstream or upstream from the transcription initiation site. Many enhancer elements derived from viruses have a broad host range and are active in a variety of tissues. For example, the SV40 early gene enhancer is suitable for many cell types. Other enhancer/ promoter combinations that are suitable for the present invention include those derived from polyoma virus, human or murine cytomegalovirus (CMV), the long term repeat from various retroviruses such as murine leukemia virus, murine or Rous sarcoma virus and HIV. See, Enhancers and Eukaryotic Expression, Cold Spring Harbor Press, Cold Spring Harbor, N.Y. 1983, which is incorporated herein by reference.

In the construction of the expression vector, the promoter is preferably positioned approximately the same distance from the heterologous transcription start site as it is from the transcription start site in its natural setting. As is known in the art, however, some variation in this distance can be accommodated without loss of promoter function.

Polyadenylation sequences can also be added to the expression vector in order to increase the efficiency of mRNA translation. Two distinct sequence elements are required for accurate and efficient polyadenylation: GU or U rich sequences located downstream from the polyadenylation site and a highly conserved sequence of six nucleotides, AAUAAA, located 11-30 nucleotides upstream. Termination and polyadenylation signals that are suitable for the present invention include those derived from SV40.

In addition to the elements already described, the expression vector of the present invention may typically contain other specialized elements intended to increase the level of expression of cloned nucleic acids or to facilitate the identification of cells that carry the recombinant DNA. For example, a number of animal viruses contain DNA sequences that promote the extra chromosomal replication of the viral genome in permissive cell types. Plasmids bearing these viral replicons are replicated episomally as long as the appropriate factors are provided by genes either carried on the plasmid or with the genome of the host cell.

The vector may or may not include a eukaryotic replicon. If a eukaryotic replicon is present, then the vector is amplifiable in eukaryotic cells using the appropriate selectable marker. If the vector does not comprise a eukaryotic replicon, no episomal amplification is possible. Instead, the recombinant DNA integrates into the genome of the engineered cell, where the promoter directs expression of the desired nucleic acid.

The expression vector of the present invention can further include additional polynucleotide sequences that allow, for example, the translation of several proteins from a single mRNA such as an internal ribosome entry site (IRES) and sequences for genomic integration of the promoter-chimeric polypeptide.

The nucleic acid construct of the present invention preferably further includes an appropriate selectable marker and/or an origin of replication. Preferably, the nucleic acid construct utilized is a shuttle vector, which can propagate both in *E. coli* (wherein the construct comprises an appropriate selectable marker and origin of replication) and be compatible for propagation in cells, or integration in a gene and a tissue of choice. The construct according to the present invention can be, for example, a plasmid, a bacmid, a phagemid, a cosmid, a phage, a virus or an artificial chromosome.

Examples of suitable constructs include, but are not limited to, pcDNA3, pcDNA3.1 (+/−), pGL3, PzeoSV2 (+/−), pDisplay, pEF/myc/cyto, pCMV/myc/cyto each of which is commercially available from Invitrogen Co. Examples of retroviral vector and packaging systems are those sold by Clontech, San Diego, Calif., including Retro-X vectors pLNCX and pLXSN, which permit cloning into multiple cloning sites and the transgene is transcribed from CMV promoter. Vectors derived from Mo-MuLV are also included such as pBabe, where the transgene will be transcribed from the 5'LTR promoter.

Viruses are very specialized infectious agents that have evolved, in many cases, to elude host defense mechanisms. Typically, viruses infect and propagate in specific cell types. The targeting specificity of viral vectors utilizes its natural specificity to specifically target predetermined cell types and thereby introduce a recombinant gene into the infected cell. Thus, the type of vector used by the present invention will depend on the cell type transformed. The ability to select suitable vectors according to the cell type transformed is well within the capabilities of the ordinary skilled artisan and as such no general description of selection consideration is provided herein. For example, bone marrow cells can be targeted using the human T cell leukemia virus type I (HTLV-I) and kidney cells may be targeted using the heterologous promoter present in the baculovirus *Autographa californica* nucleopolyhedrovirus (AcMNPV) as described in Liang C Y et al., 2004 (Arch Virol. 149: 51-60).

Recombinant viral vectors are useful for in vivo expression of the polynucleotide sequence of the present invention (e.g., SEQ ID NO: 3, 7, 11, 15, 19, or 45) since they offer advantages such as lateral infection and targeting specificity. Lateral infection is inherent in the life cycle of, for example, retrovirus and is the process by which a single infected cell produces many progeny virions that bud off and infect neighboring cells. The result is that a large area becomes rapidly infected, most of which was not initially infected by the original viral particles. This is in contrast to vertical-type of infection in which the infectious agent spreads only through daughter progeny. Viral vectors can also be produced that are unable to spread laterally. This characteristic can be useful if the desired purpose is to introduce a specified gene into only a localized number of targeted cells.

Various methods can be used to introduce the expression vector of the present invention into stem cells. Such methods are generally described in Sambrook et al., Molecular Cloning: A Laboratory Manual, Cold Springs Harbor Laboratory, New York (1989, 1992), in Ausubel et al., Current Protocols in Molecular Biology, John Wiley and Sons, Baltimore, Md. (1989), Chang et al., Somatic Gene Therapy, CRC Press, Ann Arbor, Mich. (1995), Vega et al., Gene Targeting, CRC Press, Ann Arbor Mich. (1995), Vectors: A Survey of Molecular Cloning Vectors and Their Uses, Butterworths, Boston Mass. (1988) and Gilboa et al. [Biotechniques 4 (6): 504-512, 1986] and include, for example, stable or transient transfection, lipofection, electroporation and infection with recombinant viral vectors. In addition, see U.S. Pat. Nos. 5,464,764 and 5,487,992 for positive-negative selection methods.

Introduction of nucleic acids by viral infection offers several advantages over other methods such as lipofection and electroporation, since higher transfection efficiency can be obtained due to the infectious nature of viruses.

Currently preferred in vivo nucleic acid transfer techniques include transfection with viral or non-viral constructs, such as adenovirus, lentivirus, Herpes simplex I virus, or adeno-associated virus (AAV) and lipid-based systems. Useful lipids for lipid-mediated transfer of the gene are, for example, DOTMA, DOPE, and DC-Chol [Tonkinson et al., Cancer Investigation, 14(1): 54-65 (1996)]. The most preferred constructs for use in gene therapy are viruses, most preferably adenoviruses, AAV, lentiviruses, or retroviruses. A viral construct such as a retroviral construct includes at least one transcriptional promoter/enhancer or locus-defining element(s), or other elements that control gene expression by other means such as alternate splicing, nuclear RNA export, or post-translational modification of messenger. Such vector constructs also include a packaging signal, long terminal repeats (LTRs) or portions thereof, and positive and negative strand primer binding sites appropriate to the virus used, unless it is already present in the viral construct. In addition, such a construct typically includes a signal sequence for secretion of the peptide from a host cell in which it is placed. Preferably the signal sequence for this purpose is a mammalian signal sequence or the signal sequence of the polypeptide variants of the present invention. Optionally, the construct may also include a signal that directs polyadenylation, as well as one or more restriction sites and a translation termination sequence. By way of example, such constructs will typically include a 5' LTR, a tRNA binding site, a packaging signal, an origin of second-strand DNA synthesis, and a 3' LTR or a portion thereof. Other vectors can be used that are non-viral, such as cationic lipids, polylysine, and dendrimers.

Other than containing the necessary elements for the transcription and translation of the inserted coding sequence, the expression construct of the present invention can also include sequences engineered to enhance stability, production, purification, yield or toxicity of the expressed peptide. For example, the expression of a fusion protein or a cleavable fusion protein comprising Met variant of the present invention and a heterologous protein can be engineered. Such a fusion protein can be designed so that the fusion protein can be readily isolated by affinity chromatography; e.g., by immobilization on a column specific for the heterologous protein. Where a cleavage site is engineered between the Met moiety and the heterologous protein, the Met moiety can be released from the chromatographic column by treatment with an appropriate enzyme or agent that disrupts the cleavage site [e.g., see Booth et al. (1988) Immunol. Lett. 19:65-70; and Gardella et al., (1990) J. Biol. Chem. 265:15854-158591.

As mentioned hereinabove, a variety of prokaryotic or eukaryotic cells can be used as host-expression systems to express the polypeptides of the present invention. These include, but are not limited to, microorganisms, such as bacteria transformed with a recombinant bacteriophage DNA, plasmid DNA or cosmid DNA expression vector containing the coding sequence; yeast transformed with recombinant yeast expression vectors containing the coding sequence; plant cell systems infected with recombinant virus expression vectors (e.g., cauliflower mosaic virus, CaMV; tobacco mosaic virus, TMV) or transformed with recombinant plasmid expression vectors, such as Ti plasmid, containing the coding sequence. Mammalian expression systems can also be used to express the polypeptides of the present invention.

Examples of bacterial constructs include the pET series of E. coli expression vectors [Studier et al. (1990) Methods in Enzymol. 185:60-89).

In yeast, a number of vectors containing constitutive or inducible promoters can be used, as disclosed in U.S. Pat. No. 5,932,447. Alternatively, vectors can be used which promote integration of foreign DNA sequences into the yeast chromosome.

In cases where plant expression vectors are used, the expression of the coding sequence can be driven by a number of promoters. For example, viral promoters such as the 35S RNA and 19S RNA promoters of CaMV [Brisson et al. (1984) Nature 310:511-514], or the coat protein promoter to TMV [Takamatsu et al. (1987) EMBO J. 6:307-311] can be used. Alternatively, plant promoters such as the small subunit of RUBISCO [Coruzzi et al. (1984) EMBO J. 3:1671-1680 and Brogli et al., (1984) Science 224:838-843] or heat shock promoters, e.g., soybean hsp17.5-E or hsp17.3-B [Gurley et al. (1986) Mol. Cell. Biol. 6:559-565] can be used. These constructs can be introduced into plant cells using Ti plasmid, Ri plasmid, plant viral vectors, direct DNA transformation, microinjection, electroporation and other techniques well known to the skilled artisan. See, for example, Weissbach & Weissbach, 1988, Methods for Plant Molecular Biology, Academic Press, NY, Section VIII, pp 421-463.

Other expression systems such as insects and mammalian host cell systems which are well known in the art and are further described hereinbelow can also be used by the present invention.

Recovery of the recombinant polypeptide is effected following an appropriate time in culture. The phrase "recovering the recombinant polypeptide" refers to collecting the whole fermentation medium containing the polypeptide and need not imply additional steps of separation or purification. Not withstanding the above, polypeptides of the present invention can be purified using a variety of standard protein purification techniques, such as, but not limited to, affinity chromatography, ion exchange chromatography, filtration, electrophoresis, hydrophobic interaction chromatography, gel filtration chromatography, reverse phase chromatography, concanavalin A chromatography, chromatofocusing and differential solubilization.

Hybridization Assays

Detection of a nucleic acid of interest in a biological sample may optionally be effected by hybridization-based assays using an oligonucleotide probe (non-limiting examples of probes according to the present invention were previously described). Traditional hybridization assays include PCR, RT-PCR, Real-time PCR, RNase protection, in-situ hybridization, primer extension, Southern blots (DNA detection), dot or slot blots (DNA, RNA), and Northern blots (RNA detection) (NAT type assays are described in greater detail below). More recently, PNAs have been described (Nielsen et al. 1999, Current Opin. Biotechnol. 10:71-75). Other detection methods include kits containing probes on a dipstick setup and the like.

Hybridization based assays which allow the detection of a variant of interest (i.e., DNA or RNA) in a biological sample rely on the use of oligonucleotides which can be 10, 15, 20, or 30 to 100 nucleotides long preferably from 10 to 50, more preferably from 40 to 50 nucleotides long.

Thus, the isolated polynucleotides (oligonucleotides) of the present invention are preferably hybridizable with any of the herein described nucleic acid sequences under moderate to stringent hybridization conditions.

Moderate to stringent hybridization conditions are characterized by a hybridization solution such as containing 10% dextrane sulfate, 1 M NaCl, 1% SDS and 5×106 cpm 32P labeled probe, at 65° C., with a final wash solution of 0.2× SSC and 0.1% SDS and final wash at 65° C. and whereas moderate hybridization is effected using a hybridization solution containing 10% dextrane sulfate, 1 M NaCl, 1% SDS and 5×106 cpm 32P labeled probe, at 65° C., with a final wash solution of 1×SSC and 0.1% SDS and final wash at 50° C.

More generally, hybridization of short nucleic acids (below 200 bp in length, e.g. 17-40 bp in length) can be effected using the following exemplary hybridization protocols which can be modified according to the desired stringency; (i) hybridization solution of 6×SSC and 1% SDS or 3 M TMACl, 0.01 M sodium phosphate (pH 6.8), 1 mM EDTA (pH 7.6), 0.5% SDS, 100 mg/ml denatured salmon sperm DNA and 0.1% nonfat dried milk, hybridization temperature of 1-1.5° C. below the Tm, final wash solution of 3 M TMACl, 0.01 M sodium phosphate (pH 6.8), 1 mM EDTA (pH 7.6), 0.5% SDS at 1-1.5° C. below the Tm; (ii) hybridization solution of 6×SSC and 0.1% SDS or 3 M TMACl, 0.01 M sodium phosphate (pH 6.8), 1 mM EDTA (pH 7.6), 0.5% SDS, 100 mg/ml denatured salmon sperm DNA and 0.1% nonfat dried milk, hybridization temperature of 2-2.5° C. below the Tm, final wash solution of 3 M TMACl, 0.01 M sodium phosphate (pH 6.8), 1 mM EDTA (pH 7.6), 0.5% SDS at 1-1.5° C. below the Tm, final wash solution of 6×SSC, and final wash at 22° C.; (iii) hybridization solution of 6×SSC and 1% SDS or 3 M TMACl, 0.01 M sodium phosphate (pH 6.8), 1 mM EDTA (pH 7.6), 0.5% SDS, 100 mg/ml denatured salmon sperm DNA and 0.1% nonfat dried milk, hybridization temperature.

The detection of hybrid duplexes can be carried out by a number of methods. Typically, hybridization duplexes are separated from unhybridized nucleic acids and the labels bound to the duplexes are then detected. Such labels refer to radioactive, fluorescent, biological or enzymatic tags or labels of standard use in the art. A label can be conjugated to either the oligonucleotide probes or the nucleic acids derived from the biological sample.

Probes can be labeled according to numerous well known methods. Non-limiting examples of radioactive labels include 3H, 14C, 32P, and 35S, Non-limiting examples of detectable markers include ligands, fluorophores, chemiluminescent agents, enzymes, and antibodies. Other detectable markers for use with probes, which can enable an increase in sensitivity of the method of the invention, include biotin and radio-nucleotides. It will become evident to the person of ordinary skill that the choice of a particular label dictates the manner in which it is bound to the probe.

For example, oligonucleotides of the present invention can be labeled subsequent to synthesis, by incorporating biotinylated dNTPs or rNTP, or some similar means (e.g., photo-cross-linking a psoralen derivative of biotin to RNAs), followed by addition of labeled streptavidin (e.g., phycoerythrin-conjugated streptavidin) or the equivalent. Alternatively, when fluorescently-labeled oligonucleotide probes are used, fluorescein, lissamine, phycoerythrin, rhodamine (Perkin Elmer Cetus), Cy2, Cy3, Cy3.5, Cy5, Cy5.5, Cy7, FluorX (Amersham) and others [e.g., Kricka et al. (1992), Academic Press San Diego, Calif] can be attached to the oligonucleotides.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays. For instance, samples may be hybridized to an irrelevant probe and treated with RNAse A prior to hybridization, to assess false hybridization.

Although the present invention is not specifically dependent on the use of a label for the detection of a particular nucleic acid sequence, such a label might be beneficial, by increasing the sensitivity of the detection. Furthermore, it enables automation. Probes can be labeled according to numerous well known methods. As commonly known, radioactive nucleotides can be incorporated into probes of the invention by several methods. Non-limiting examples of radioactive labels include 3H, 14C, 32P, and 35S.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays.

Probes of the invention can be utilized with naturally occurring sugar-phosphate backbones as well as modified backbones including phosphorothioates, dithionates, alkyl phosphonates and a-nucleotides and the like. Probes of the invention can be constructed of either ribonucleic acid (RNA) or deoxyribonucleic acid (DNA), and preferably of DNA.

Amino Acid Sequences and Peptides

The terms "polypeptide," "peptide" and "protein" are used interchangeably herein to refer to a polymer of amino acid residues. The terms apply to amino acid polymers in which one or more amino acid residue is an analog or mimetic of a corresponding naturally occurring amino acid, as well as to naturally occurring amino acid polymers. Polypeptides can be modified, e.g., by the addition of carbohydrate residues to form glycoproteins. The terms "polypeptide," "peptide" and "protein" include glycoproteins, as well as non-glycoproteins.

Polypeptide products can be biochemically synthesized such as by employing standard solid phase techniques. Such methods include but are not limited to exclusive solid phase synthesis, partial solid phase synthesis methods, fragment condensation, classical solution synthesis. These methods are preferably used when the peptide is relatively short (i.e., 10 kDa) and/or when it cannot be produced by recombinant techniques (i.e., not encoded by a nucleic acid sequence) and therefore involves different chemistry.

Solid phase polypeptide synthesis procedures are well known in the art and further described by John Morrow Stewart and Janis Dillaha Young, Solid Phase Peptide Syntheses (2nd Ed., Pierce Chemical Company, 1984).

Synthetic polypeptides can optionally be purified by preparative high performance liquid chromatography [Creighton T. (1983) Proteins, structures and molecular principles. WH Freeman and Co. N.Y.], after which their composition can be confirmed via amino acid sequencing.

In cases where large amounts of a polypeptide are desired, it can be generated using recombinant techniques such as described by Bitter et al., (1987) Methods in Enzymol. 153: 516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463.

The present invention also encompasses polypeptides encoded by the polynucleotide sequences of the present invention, as well as polypeptides according to the amino acid sequences described herein. The present invention also encompasses homologues of these polypeptides, such homologues can be at least 50%, at least 55%, at least 60%, at least 65%, at least 70%, at least 75%, at least 80%, at least 85%, at least 95% or more say 100% homologous to the amino acid sequences set forth below, as can be determined using BlastP software of the National Center of Biotechnology Information (NCBI) using default parameters, optionally and preferably including the following: filtering on (this option filters repetitive or low-complexity sequences from the query using the Seg (protein) program), scoring matrix is BLOSUM62 for proteins, word size is 3, E value is 10, gap costs are 11, 1 (initialization and extension), and number of alignments shown is 50. Finally, the present invention also encompasses fragments of the above described polypeptides and polypeptides having mutations, such as deletions, insertions or substitutions of one or more amino acids, either naturally occurring or artificially induced, either randomly or in a targeted fashion.

It will be appreciated that peptides identified according the present invention may be degradation products, synthetic peptides or recombinant peptides as well as peptidomimetics, typically, synthetic peptides and peptoids and semipeptoids which are peptide analogs, which may have, for example, modifications rendering the peptides more stable while in a body or more capable of penetrating into cells. Such modifications include, but are not limited to N terminus modification, C terminus modification, peptide bond modification, including, but not limited to, CH2-NH, CH2-S, CH2-S=O, O=C—NH, CH2-O, CH2-CH2, S=C—NH, CH=CH or CF=CH, backbone modifications, and residue modification. Methods for preparing peptidomimetic compounds are well known in the art and are specified. Further details in this respect are provided hereinunder.

Peptide bonds (—CO—NH—) within the peptide may be substituted, for example, by N-methylated bonds (—N(CH3)-CO—), ester bonds (—C(R)H—C—O—O—C(R)—N—), ketomethylen bonds (—CO—CH2-), *-aza bonds (—NH—N(R)—CO—), wherein R is any alkyl, e.g., methyl, carba bonds (—CH2-NH—), hydroxyethylene bonds (—CH(OH)—CH2-), thioamide bonds (—CS—NH—), olefinic double bonds (—CH=CH—), retro amide bonds (—NH—CO—), peptide derivatives (—N(R)—CH2-CO—), wherein R is the "normal" side chain, naturally presented on the carbon atom. These modifications can occur at any of the bonds along the peptide chain and even at several (2-3) at the same time.

Natural aromatic amino acids, Trp, Tyr and Phe, may be substituted for synthetic non-natural acid such as Phenylglycine, TIC, naphthylelanine (Nol), ring-methylated derivatives of Phe, halogenated derivatives of Phe or o-methyl-Tyr.

In addition to the above, the peptides of the present invention may also include one or more modified amino acids or one or more non-amino acid monomers (e.g. fatty acids, complex carbohydrates etc).

As used herein in the specification and in the claims section below the term "amino acid" or "amino acids" is understood to include the 20 naturally occurring amino acids; those amino acids often modified post-translationally in vivo, including, for example, hydroxyproline, phosphoserine and phosphothreonine; and other unusual amino acids including, but not limited to, 2-aminoadipic acid, hydroxylysine, isodesmosine, nor-valine, nor-leucine and ornithine. Furthermore, the term "amino acid" includes both D- and L-amino acids.

Table 1 non-conventional or modified amino acids which can be used with the present invention.

TABLE 1

| Non-conventional amino acid | Code | Non-conventional amino acid | Code |
|---|---|---|---|
| α-aminobutyric acid | Abu | L-N-methylalanine | Nmala |
| α-amino-α-methylbutyrate | Mgabu | L-N-methylarginine | Nmarg |
| aminocyclopropane-Carboxylate | Cpro | L-N-methylasparagine | Nmasn |
|  |  | L-N-methylaspartic acid | Nmasp |
| aminoisobutyric acid | Aib | L-N-methylcysteine | Nmcys |
| aminonorbornyl-Carboxylate | Norb | L-N-methylglutamine | Nmgln |
|  |  | L-N-methylglutamic acid | Nmglu |
| Cyclohexylalanine | Chexa | L-N-methylhistidine | Nmhis |
| Cyclopentylalanine | Cpen | L-N-methylisolleucine | Nmile |
| D-alanine | Dal | L-N-methylleucine | Nmleu |
| D-arginine | Darg | L-N-methyllysine | Nmlys |
| D-aspartic acid | Dasp | L-N-methylmethionine | Nmmet |
| D-cysteine | Dcys | L-N-methylnorleucine | Nmnle |
| D-glutamine | Dgln | L-N-methylnorvaline | Nmnva |
| D-glutamic acid | Dglu | L-N-methylornithine | Nmorn |
| D-histidine | Dhis | L-N-methylphenylalanine | Nmphe |
| D-isoleucine | Dile | L-N-methylproline | Nmpro |
| D-leucine | Dleu | L-N-methylserine | Nmser |
| D-lysine | Dlys | L-N-methylthreonine | Nmthr |
| D-methionine | Dmet | L-N-methyltryptophan | Nmtrp |
| D-ornithine | Dorn | L-N-methyltyrosine | Nmtyr |
| D-phenylalanine | Dphe | L-N-methylvaline | Nmval |

TABLE 1-continued

| Non-conventional amino acid | Code | Non-conventional amino acid | Code |
|---|---|---|---|
| D-proline | Dpro | L-N-methylethylglycine | Nmetg |
| D-serine | Dser | L-N-methyl-t-butylglycine | Nmtbug |
| D-threonine | Dthr | L-norleucine | Nle |
| D-tryptophan | Dtrp | L-norvaline | Nva |
| D-tyrosine | Dtyr | α-methyl-aminoisobutyrate | Maib |
| D-valine | Dval | α-methyl-γ-aminobutyrate | Mgabu |
| D-α-methylalanine | Dmala | α-methylcyclohexylalanine | Mchexa |
| D-α-methylarginine | Dmarg | α-methylcyclopentylalanine | Mcpen |
| D-α-methylasparagine | Dmasn | α-methyl-α-napthylalanine | Manap |
| D-α-methylaspartate | Dmasp | α-methylpenicillamine | Mpen |
| D-α-methylcysteine | Dmcys | N-(4-aminobutyl)glycine | Nglu |
| D-α-methylglutamine | Dmgln | N-(2-aminoethyl)glycine | Naeg |
| D-α-methylhistidine | Dmhis | N-(3-aminopropyl)glycine | Norn |
| D-α-methylisoleucine | Dmile | N-amino-α-methylbutyrate | Nmaabu |
| D-α-methylleucine | Dmleu | α-napthylalanine | Anap |
| D-α-methyllysine | Dmlys | N-benzylglycine | Nphe |
| D-α-methylmethionine | Dmmet | N-(2-carbamylethyl)glycine | Ngln |
| D-α-methylornithine | Dmorn | N-(carbamylmethyl)glycine | Nasn |
| D-α-methylphenylalanine | Dmphe | N-(2-carboxyethyl)glycine | Nglu |
| D-α-methylproline | Dmpro | N-(carboxymethyl)glycine | Nasp |
| D-α-methylserine | Dmser | N-cyclobutylglycine | Ncbut |
| D-α-methylthreonine | Dmthr | N-cycloheptylglycine | Nchep |
| D-α-methyltryptophan | Dmtrp | N-cyclohexylglycine | Nchex |
| D-α-methyltyrosine | Dmty | N-cyclodecylglycine | Ncdec |
| D-α-methylvaline | Dmval | N-cyclododeclglycine | Ncdod |
| D-α-methylalnine | Dnmala | N-cyclooctylglycine | Ncoct |
| D-α-methylarginine | Dnmarg | N-cyclopropylglycine | Ncpro |
| D-α-methylasparagine | Dnmasn | N-cycloundecylglycine | Ncund |
| D-α-methylasparatate | Dnmasp | N-(2,2-diphenylethyl)glycine | Nbhm |
| D-α-methylcysteine | Dnmcys | N-(3,3-diphenylpropyl)glycine | Nbhe |
| D-N-methylleucine | Dnmleu | N-(3-indolylethyl) glycine | Nhtrp |
| D-N-methyllysine | Dnmlys | N-methyl-γ-aminobutyrate | Nmgabu |
| N-methylcyclohexylalanine | Nmchexa | D-N-methylmethionine | Dnmmet |
| D-N-methylornithine | Dnmorn | N-methylcyclopentylalanine | Nmcpen |
| N-methylglycine | Nala | D-N-methylphenylalanine | Dnmphe |
| N-methylaminoisobutyrate | Nmaib | D-N-methylproline | Dnmpro |
| N-(1-methylpropyl)glycine | Nile | D-N-methylserine | Dnmser |
| N-(2-methylpropyl)glycine | Nile | D-N-methylserine | Dnmser |
| N-(2-methylpropyl)glycine | Nleu | D-N-methylthreonine | Dnmthr |
| D-N-methyltryptophan | Dnmtrp | N-(1-methylethyl)glycine | Nva |
| D-N-methyltyrosine | Dnmtyr | N-methyla-napthylalanine | Nmanap |
| D-N-methylvaline | Dnmval | N-methylpenicillamine | Nmpen |
| γ-aminobutyric acid | Gabu | N-(p-hydroxyphenyl)glycine | Nhtyr |
| L-t-butylglycine | Tbug | N-(thiomethyl)glycine | Ncys |
| L-ethylglycine | Etg | penicillamine | Pen |
| L-homophenylalanine | Hphe | L-α-methylalanine | Mala |
| L-α-methylarginine | Marg | L-α-methylasparagine | Masn |
| L-α-methylaspartate | Masp | L-α-methyl-t-butylglycine | Mtbug |
| L-α-methylcysteine | Mcys | L-methylethylglycine | Metg |
| L-α-methylglutamine | Mgln | L-α-methylglutamate | Mglu |
| L-α-methylhistidine | Mhis | L-α-methylhomophenylalanine | Mhphe |
| L-α-methylisoleucine | Mile | N-(2-methylthioethyl)glycine | Nmet |
| D-N-methylglutamine | Dnmgln | N-(3-guanidinopropyl)glycine | Narg |
| D-N-methylglutamate | Dnmglu | N-(1-hydroxyethyl)glycine | Nthr |
| D-N-methylhistidine | Dnmhis | N-(hydroxyethyl)glycine | Nser |
| D-N-methylisoleucine | Dnmile | N-(imidazolylethyl)glycine | Nhis |
| D-N-methylleucine | Dnmleu | N-(3-indolylethyl)glycine | Nhtrp |
| D-N-methyllysine | Dnmlys | N-methyl-γ-aminobutyrate | Nmgabu |
| N-methylcyclohexylalanine | Nmchexa | D-N-methylmethionine | Dnmmet |
| D-N-methylornithine | Dnmorn | N-methylcyclopentylalanine | Nmcpen |
| N-methylglycine | Nala | D-N-methylphenylalanine | Dnmphe |
| N-methylaminoisobutyrate | Nmaib | D-N-methylproline | Dnmpro |
| N-(1-methylpropyl)glycine | Nile | D-N-methylserine | Dnmser |
| N-(2-methylpropyl)glycine | Nleu | D-N-methylthreonine | Dnmthr |
| D-N-methyltryptophan | Dnmtrp | N-(1-methylethyl)glycine | Nval |
| D-N-methyltyrosine | Dnmtyr | N-methyla-napthylalanine | Nmanap |
| D-N-methylvaline | Dnmval | N-methylpenicillamine | Nmpen |
| γ-aminobutyric acid | Gabu | N-(p-hydroxyphenyl)glycine | Nhtyr |
| L-t-butylglycine | Tbug | N-(thiomethyl)glycine | Ncys |
| L-ethylglycine | Etg | penicillamine | Pen |
| L-homophenylalanine | Hphe | L-α-methylalanine | Mala |
| L-α-methylarginine | Marg | L-α-methylasparagine | Masn |
| L-α-methylaspartate | Masp | L-α-methyl-t-butylglycine | Mtbug |
| L-α-methylcysteine | Mcys | L-methylethylglycine | Metg |
| L-α-methylglutamine | Mgln | L-α-methylglutamate | Mglu |
| L-α-methylhistidine | Mhis | L-α-methylhomophenylalanine | Mhphe |
| L-α-methylisoleucine | Mile | N-(2-methylthioethyl)glycine | Nmet |
| L-α-methylleucine | Mleu | L-α-methyllysine | Mlys |

TABLE 1-continued

| Non-conventional amino acid | Code | Non-conventional amino acid | Code |
|---|---|---|---|
| L-α-methylmethionine | Mmet | L-α-methylnorleucine | Mnle |
| L-α-methylnorvaline | Mnva | L-α-methylornithine | Morn |
| L-α-methylphenylalanine | Mphe | L-α-methylproline | Mpro |
| L-α-methylserine | mser | L-α-methylthreonine | Mthr |
| L-α-methylvaline | Mtrp | L-α-methyltyrosine | Mtyr |
| L-α-methylleucine | Mval | L-N-methylhomophenylalanine | Nmhphe |
|  | Nnbhm | N-(N-(3,3-diphenylpropyl) | Nnbhe |
| N-(N-(2,2-diphenylethyl) carbamylmethyl-glycine | Nnbhm | carbamylmethyl(1)glycine |  |
| 1-carboxy-1-(2,2-diphenyl ethylamino)cyclopropane | Nmbc |  |  |

Since the peptides of the present invention are preferably utilized in therapeutics which require the peptides to be in soluble form, the peptides of the present invention preferably include one or more non-natural or natural polar amino acids, including but not limited to serine and threonine which are capable of increasing peptide solubility due to their hydroxyl-containing side chain.

The peptides of the present invention are preferably utilized in a linear form, although it will be appreciated that in cases where cyclicization does not severely interfere with peptide characteristics, cyclic forms of the peptide can also be utilized.

The peptides of present invention can be biochemically synthesized such as by using standard solid phase techniques. These methods include exclusive solid phase synthesis well known in the art, partial solid phase synthesis methods, fragment condensation, classical solution synthesis. These methods are preferably used when the peptide is relatively short (i.e., 10 kDa) and/or when it cannot be produced by recombinant techniques (i.e., not encoded by a nucleic acid sequence) and therefore involves different chemistry.

Synthetic peptides can be purified by preparative high performance liquid chromatography and the composition of which can be confirmed via amino acid sequencing.

In cases where large amounts of the peptides of the present invention are desired, the peptides of the present invention can be generated using recombinant techniques such as described by Bitter et al., (1987) Methods in Enzymol. 153: 516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463 and also as described above.

Peptide sequences which exhibit high therapeutic activity, such as by competing with wild type signaling proteins of the same signaling pathway, can be also uncovered using computational biology. Software programs useful for displaying three-dimensional structural models, such as RIBBONS (Carson, M., 1997. Methods in Enzymology 277, 25), O (Jones, T A. et al., 1991. Acta Crystallogr. A47, 110), DINO (DINO: Visualizing Structural Biology (2001); and QUANTA, INSIGHT, SYBYL, MACROMODE, ICM, MOLMOL, RASMOL and GRASP (reviewed in Kraulis, J., 1991. Appl Crystallogr. 24, 946) can be utilized to model interactions between the polypeptides of the present invention and prospective peptide sequences to thereby identify peptides which display the highest probability of binding for example to a respective ligand (e.g., IL-10). Computational modeling of protein-peptide interactions has been successfully used in rational drug design, for further details, see Lam et al., 1994. Science 263, 380; Wlodawer et al., 1993. Ann Rev Biochem. 62, 543; Appelt, 1993. Perspectives in Drug Discovery and Design 1, 23; Erickson, 1993. Perspectives in Drug Discovery and Design 1, 109, and Mauro M J. et al., 2002. J Clin Oncol. 20, 325-34.

Antibodies

"Antibody" refers to a polypeptide ligand that is preferably substantially encoded by an immunoglobulin gene or immunoglobulin genes, or fragments thereof, which specifically binds and recognizes an epitope (e.g., an antigen). The recognized immunoglobulin genes include the kappa and lambda light chain constant region genes, the alpha, gamma, delta, epsilon and mu heavy chain constant region genes, and the myriad-immunoglobulin variable region genes. Antibodies exist, e.g., as intact immunoglobulins or as a number of well characterized fragments produced by digestion with various peptidases. This includes, e.g., Fab' and F(ab)'2 fragments. The term "antibody," as used herein, also includes antibody fragments either produced by the modification of whole antibodies or those synthesized de novo using recombinant DNA methodologies. It also includes polyclonal antibodies, monoclonal antibodies, chimeric antibodies, humanized antibodies, or single chain antibodies. "Fc" portion of an antibody refers to that portion of an immunoglobulin heavy chain that comprises one or more heavy chain constant region domains, CH1, CH2 and CH3, but does not include the heavy chain variable region.

The functional fragments of antibodies, such as Fab, F(ab')2, and Fv that are capable of binding to macrophages, are described as follows: (1) Fab, the fragment which contains a monovalent antigen-binding fragment of an antibody molecule, can be produced by digestion of whole antibody with the enzyme papain to yield an intact light chain and a portion of one heavy chain; (2) Fab', the fragment of an antibody molecule that can be obtained by treating whole antibody with pepsin, followed by reduction, to yield an intact light chain and a portion of the heavy chain; two Fab' fragments are obtained per antibody molecule; (3) (Fab')2, the fragment of the antibody that can be obtained by treating whole antibody with the enzyme pepsin without subsequent reduction; F(ab')2 is a dimer of two Fab' fragments held together by two disulfide bonds; (4) Fv, defined as a genetically engineered fragment containing the variable region of the light chain and the variable region of the heavy chain expressed as two chains; and (5) Single chain antibody ("SCA"), a genetically engineered molecule containing the variable region of the light chain and the variable region of the heavy chain, linked by a suitable polypeptide linker as a genetically fused single chain molecule.

Methods of producing polyclonal and monoclonal antibodies as well as fragments thereof are well known in the art (See for example, Harlow and Lane, Antibodies: A Laboratory Manual, Cold Spring Harbor Laboratory, New York, 1988, incorporated herein by reference).

Antibody fragments according to the present invention can be prepared by proteolytic hydrolysis of the antibody or by expression in E. coli or mammalian cells (e.g. Chinese hamster ovary cell culture or other protein expression systems) of DNA encoding the fragment. Antibody fragments can be obtained by pepsin or papain digestion of whole antibodies by conventional methods. For example, antibody fragments can be produced by enzymatic cleavage of antibodies with pepsin to provide a 5S fragment denoted F(ab')2. This fragment can be further cleaved using a thiol reducing agent, and optionally a blocking group for the sulfhydryl groups resulting from cleavage of disulfide linkages, to produce 3.5S Fab' monovalent fragments. Alternatively, an enzymatic cleavage using pepsin produces two monovalent Fab' fragments and an Fc fragment directly. These methods are described, for example, by Goldenberg, U.S. Pat. Nos. 4,036,945 and 4,331,647, and references contained therein, which patents are hereby incorporated by reference in their entirety. See also Porter, R. R. [Biochem. J. 73: 119-126 (1959)]. Other methods of cleaving antibodies, such as separation of heavy chains to form monovalent light-heavy chain fragments, further cleavage of fragments, or other enzymatic, chemical, or genetic techniques may also be used, so long as the fragments bind to the antigen that is recognized by the intact antibody.

Fv fragments comprise an association of VH and VL chains. This association may be noncovalent, as described in Inbar et al. [Proc. Nat'l Acad. Sci. USA 69:2659-62 (19720]. Alternatively, the variable chains can be linked by an intermolecular disulfide bond or cross-linked by chemicals such as glutaraldehyde. Preferably, the Fv fragments comprise VH and VL chains connected by a peptide linker. These single-chain antigen binding proteins (sFv) are prepared by constructing a structural gene comprising DNA sequences encoding the VH and VL domains connected by an oligonucleotide. The structural gene is inserted into an expression vector, which is subsequently introduced into a host cell such as E. coli. The recombinant host cells synthesize a single polypeptide chain with a linker peptide bridging the two V domains. Methods for producing sFvs are described, for example, by [Whitlow and Filpula, Methods 2: 97-105 (1991); Bird et al., Science 242:423-426 (1988); Pack et al., Bio/Technology 11:1271-77 (1993); and U.S. Pat. No. 4,946,778, which is hereby incorporated by reference in its entirety.

Another form of an antibody fragment is a peptide coding for a single complementarity-determining region (CDR). CDR peptides ("minimal recognition units") can be obtained by constructing genes encoding the CDR of an antibody of interest. Such genes are prepared, for example, by using the polymerase chain reaction to synthesize the variable region from RNA of antibody-producing cells. See, for example, Larrick and Fry [Methods, 2: 106-10 (1991)].

Humanized forms of non-human (e.g., murine) antibodies are chimeric molecules of immunoglobulins, immunoglobulin chains or fragments thereof (such as Fv, Fab, Fab', F(ab') or other antigen-binding subsequences of antibodies) which contain minimal sequence derived from non-human immunoglobulin. Humanized antibodies include human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., Nature, 321: 522-525 (1986); Riechmann et al., Nature, 332:323-329 (1988); and Presta, Curr. Op. Struct. Biol., 2:593-596 (1992)].

Methods for humanizing non-human antibodies are well known in the art. Generally, a humanized antibody has one or more amino acid residues introduced into it from a source which is non-human. These non-human amino acid residues are often referred to as import residues, which are typically taken from an import variable domain. Humanization can be essentially performed following the method of Winter and co-workers [Jones et al., Nature, 321:522-525 (1986); Riechmann et al., Nature 332:323-327 (1988); Verhoeyen et al., Science, 239:1534-1536 (1988)1, by substituting rodent CDRs or CDR sequences for the corresponding sequences of a human antibody. Accordingly, such humanized antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, J. Mol. Biol., 227:381 (1991); Marks et al., J. Mol. Biol., 222:581 (1991)]. The techniques of Cole et al. and Boerner et al. are also available for the preparation of human monoclonal antibodies (Cole et al., Monoclonal Antibodies and Cancer Therapy, Alan R. Liss, p. 77 (1985) and Boerner et al., J. Immunol., 147(1):86-95 (1991)]. Similarly, human antibodies can be made by introduction of human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in the following scientific publications: Marks et al., Bio/Technology 10,: 779-783 (1992); Lonberg et al., Nature 368: 856-859 (1994); Morrison, Nature 368 812-13 (1994); Fishwild et al., Nature Biotechnology 14, 845-51 (1996); Neuberger, Nature Biotechnology 14: 826 (1996); and Lonberg and Huszar, Intern. Rev. Immunol. 13, 65-93 (1995).

Preferably, the antibody of this aspect of the present invention specifically binds at least one epitope of the polypeptide variants of the present invention. As used herein, the term "epitope" refers to any antigenic determinant on an antigen to which the paratope of an antibody binds.

Epitopic determinants usually consist of chemically active surface groupings of molecules such as amino acids or carbohydrate side chains and usually have specific three dimensional structural characteristics, as well as specific charge characteristics.

Optionally, a unique epitope may be created in a variant due to a change in one or more post-translational modifications, including but not limited to glycosylation and/or phosphorylation, as described below. Such a change may also cause a new epitope to be created, for example through removal of glycosylation at a particular site.

An epitope according to the present invention may also optionally comprise part or all of a unique sequence portion of a variant according to the present invention in combination with at least one other portion of the variant which is not contiguous to the unique sequence portion in the linear polypeptide itself, yet which are able to form an epitope in combination. One or more unique sequence portions may optionally combine with one or more other non-contiguous portions of the variant (including a portion which may have high homology to a portion of the known protein) to form an epitope.

Display Libraries

According to still another aspect of the present invention there is provided a display library comprising a plurality of display vehicles (such as phages, viruses or bacteria) each displaying at least 6, at least 7, at least 8, at least 9, at least 10, 10-15, 12-17, 15-20, 15-30 or 20-50 consecutive amino acids derived from the polypeptide sequences of the present invention.

Since in therapeutic applications it is highly desirable to employ the minimal and most efficacious polypeptide regions, which still exert therapeutic function, identification of such peptide regions can be effected using various approaches, including, for example, display techniques as described herein.

Methods of constructing such display libraries are well known in the art. Such methods are described in, for example, Young A C, et al., "The three-dimensional structures of a polysaccharide binding antibody to *Cryptococcus neoformans* and its complex with a peptide from a phage display library: implications for the identification of peptide mimotopes" J Mol Biol 1997 Dec. 12; 274(4):622-34; Giebel L B et al. "Screening of cyclic peptide phage libraries identifies ligands that bind streptavidin with high affinities" Biochemistry 1995 Nov. 28; 34(47):15430-5; Davies E L et al., "Selection of specific phage-display antibodies using libraries derived from chicken immunoglobulin genes" J Immunol Methods 1995 Oct. 12; 186(1):125-35; Jones C RT al. "Current trends in molecular recognition and bioseparation" J Chromatogr A 1995 Jul. 14; 707(1):3-22; Deng S J et al. "Basis for selection of improved carbohydrate-binding single-chain antibodies from synthetic gene libraries" Proc Natl Acad Sci USA 1995 May 23; 92(11):4992-6; and Deng S J et al. "Selection of antibody single-chain variable fragments with improved carbohydrate binding by phage display" J Biol Chem 1994 Apr. 1; 269(13):9533-8, which are incorporated herein by reference.

The principles and operation of the present invention may be better understood with reference to the drawings and accompanying descriptions.

Before explaining at least one embodiment of the invention in detail, it is to be understood that the invention is not limited in its application to the details set forth in the following description or exemplified by the Examples. The invention is capable of other embodiments or of being practiced or carried out in various ways. Also, it is to be understood that the phraseology and terminology employed herein is for the purpose of description and should not be regarded as limiting.

A "variant-treatable" disease refers to any disease that is treatable by using a splice variant of any of the therapeutic proteins according to the present invention. "Treatment" also encompasses prevention, amelioration, elimination and control of the disease and/or pathological condition. The diseases for which such variants may be useful therapeutic agents are described in greater detail below for each of the variants. The variants themselves are described by "cluster" or by gene, as these variants are splice variants of known proteins. Therefore, a "cluster-related disease" or a "protein-related disease" refers to a disease that may be treated by a particular protein, with regard to the description of such diseases below a therapeutic protein variant according to the present invention.

The term "biologically active", as used herein, refers to a protein having structural, regulatory, or biochemical functions of a naturally occurring molecule. Likewise, "immunologically active" refers to the capability of the natural, recombinant, or synthetic ligand, or any oligopeptide thereof, to induce a specific immune response in appropriate animals or cells and to bind with specific antibodies.

The term "modulate", as used herein, refers to a change in the activity of at least one receptor mediated activity. For example, modulation may cause an increase or a decrease in protein activity, binding characteristics, or any other biological, functional or immunological properties of a ligand.

Methods of Treatment

As mentioned hereinabove the novel therapeutic protein variants of the present invention and compositions derived therefrom (i.e., peptides, oligonucleotides) can be used to treat cluster or protein-related diseases, disorders or conditions.

Thus, according to an additional aspect of the present invention there is provided a method of treating cluster or protein-related disease, disorder or condition in a subject.

The subject according to the present invention is a mammal, preferably a human which is diagnosed with one of the disease, disorder or conditions described hereinabove, or alternatively is predisposed to at least one type of the cluster or protein-related disease, disorder or conditions described hereinabove.

As used herein the term "treating" refers to preventing, curing, reversing, attenuating, alleviating, minimizing, suppressing or halting the deleterious effects of the above-described diseases, disorders or conditions.

Treating, according to the present invention, can be effected by specifically upregulating or alternatively downregulating the expression of at least one of the polypeptides of the present invention in the subject.

Optionally, upregulation may be effected by administering to the subject at least one of the polypeptides of the present invention (e.g., recombinant or synthetic) or an active portion thereof, as described herein (e.g., SEQ ID NO:1, 5, 9, 13, 17 or 54). However, since the bioavailability of large polypeptides may potentially be relatively small due to high degradation rate and low penetration rate, administration of polypeptides is preferably confined to small peptide fragments (e.g., about 100 amino acids). The polypeptide or peptide may optionally be administered in as part of a pharmaceutical composition, described in more detail below.

It will be appreciated that treatment of the above-described diseases according to the present invention may be combined with other treatment methods known in the art (i.e., combination therapy). Thus, treatment of malignancies using the agents of the present invention may be combined with, for example, radiation therapy, antibody therapy and/or chemotherapy.

Alternatively or additionally, an upregulating method may optionally be effected by specifically upregulating the amount (optionally expression) in the subject of at least one of the polypeptides of the present invention (e.g., SEQ ID NO: 1, 5, 9, 13, 17 or 54) or active portions thereof.

As is mentioned hereinabove and in the Examples section which follows, the biomolecular sequences of this aspect of the present invention may be used as valuable therapeutic tools in the treatment of diseases, disorders or conditions in which altered activity or expression of the wild-type gene product is known to contribute to disease, disorder or condition onset or progression. For example, in case a disease is caused by overexpression of a membrane bound-receptor, a soluble variant thereof may be used as an antagonist which competes with the receptor for binding the ligand, to thereby terminate signaling from the receptor. Examples of such diseases are listed in the Examples section which follows.

It will be appreciated that the polypeptides of the present invention may also have agonistic properties. These include increasing the stability of the ligand (e.g., IL-4), protection from proteolysis and modification of the pharmacokinetic properties of the ligand (i.e., increasing the half-life of the ligand, while decreasing the clearance thereof). As such, the biomolecular sequences of this aspect of the present invention may be used to treat conditions or diseases in which the wild-type gene product plays a favorable role, for example, increasing angiogenesis in cases of diabetes or ischemia.

Upregulating expression of the therapeutic protein or polypeptide variants of the present invention may be effected via the administration of at least one of the exogenous polynucleotide sequences of the present invention (e.g., SEQ ID NO:3, 11, 15, 19, 45), ligated into a nucleic acid expression construct (as described in greater detail hereinabove) designed for expression of coding sequences in eukaryotic cells (e.g., mammalian cells), as described above. Accordingly, the exogenous polynucleotide sequence may be a DNA or RNA sequence encoding the variants of the present invention or active portions thereof.

It will be appreciated that the nucleic acid construct can be administered to the individual employing any suitable mode of administration including in vivo gene therapy (e.g., using viral transformation as described hereinabove). Alternatively, the nucleic acid construct is introduced into a suitable cell via an appropriate gene delivery vehicle/method (transfection, transduction, homologous recombination, etc.) and an expression system as needed and then the modified cells are expanded in culture and returned to the individual (i.e., ex-vivo gene therapy).

Such cells (i.e., which are transfected with the nucleic acid construct of the present invention) can be any suitable cells, such as kidney, bone marrow, keratinocyte, lymphocyte, adult stem cells, cord blood cells, embryonic stem cells which are derived from the individual and are transfected ex vivo with an expression vector containing the polynucleotide designed to express the polypeptide of the present invention as described hereinabove.

Administration of the ex vivo transfected cells of the present invention can be effected using any suitable route such as intravenous, intra peritoneal, intra kidney, intra gastrointestinal track, subcutaneous, transcutaneous, intramuscular, intracutaneous, intrathecal, epidural and rectal. According to presently preferred embodiments, the ex vivo transfected cells of the present invention are introduced to the individual using intravenous, intra kidney, intra gastrointestinal track and/or intra peritoneal administrations.

The ex vivo transfected cells of the present invention can be derived from either autologous sources such as self bone marrow cells or from allogeneic sources such as bone marrow or other cells derived from non-autologous sources. Since non-autologous cells are likely to induce an immune reaction when administered to the body several approaches have been developed to reduce the likelihood of rejection of non-autologous cells. These include either suppressing the recipient immune system or encapsulating the non-autologous cells or tissues in immunoisolating, semipermeable membranes before transplantation.

Encapsulation techniques are generally classified as microencapsulation, involving small spherical vehicles and macroencapsulation, involving larger flat-sheet and hollow-fiber membranes (Uludag, H. et al. Technology of mammalian cell encapsulation. Adv Drug Deliv Rev. 2000; 42: 29-64).

Methods of preparing microcapsules are known in the arts and include for example those disclosed by Lu M Z, et al., Cell encapsulation with alginate and alpha-phenoxycin-namylidene-acetylated poly(allylamine). Biotechnol Bioeng. 2000, 70: 479-83, Chang T M and Prakash S. Procedures for microencapsulation of enzymes, cells and genetically engineered microorganisms. Mol Biotechnol. 2001, 17: 249-60, and Lu M Z, et al., A novel cell encapsulation method using photosensitive poly(allylamine alpha-cyanocinnamylidene-acetate). J Microencapsul. 2000, 17: 245-51.

For example, microcapsules are prepared by complexing modified collagen with a ter-polymer shell of 2-hydroxyethyl methylacrylate (HEMA), methacrylic acid (MAA) and methyl methacrylate (MMA), resulting in a capsule thickness of 2-5 μm. Such microcapsules can be further encapsulated with additional 2-5 μm ter-polymer shells in order to impart a negatively charged smooth surface and to minimize plasma protein absorption (Chia, S. M. et al. Multi-layered microcapsules for cell encapsulation Biomaterials. 2002 23: 849-56).

Other microcapsules are based on alginate, a marine polysaccharide (Sambanis, A. Encapsulated islets in diabetes treatment. Diabetes Thechnol. Ther. 2003, 5: 665-8) or its derivatives. For example, microcapsules can be prepared by the polyelectrolyte complexation between the polyanions sodium alginate and sodium cellulose sulphate with the polycation poly(methylene-co-guanidine) hydrochloride in the presence of calcium chloride.

It will be appreciated that cell encapsulation is improved when smaller capsules are used. Thus, the quality control, mechanical stability, diffusion properties, and in vitro activities of encapsulated cells improved when the capsule size was reduced from 1 mm to 400 μm (Canaple L. et al., Improving cell encapsulation through size control. J Biomater Sci Polym Ed. 2002; 13: 783-96). Moreover, nanoporous biocapsules with well-controlled pore size as small as 7 nm, tailored surface chemistries and precise microarchitectures were found to successfully immunoisolate microenvironments for cells (Williams D. Small is beautiful: microparticle and nanoparticle technology in medical devices. Med Device Technol. 1999, 10: 6-9; Desai, T. A. Microfabrication technology for pancreatic cell encapsulation. Expert Opin Biol Ther. 2002, 2: 633-46).

It will be appreciated that the present methodology may also be effected by specifically upregulating the expression of the variants of the present invention endogenously in the subject. Agents for upregulating endogenous expression of specific splice variants of a given gene include antisense oligonucleotides, which are directed at splice sites of interest, thereby altering the splicing pattern of the gene. This approach has been successfully used for shifting the balance of expression of the two isoforms of Bcl-x [Taylor (1999) Nat. Biotechnol. 17:1097-1100; and Mercatante (2001) J. Biol. Chem. 276:16411-164171; IL-5R [Karras (2000) Mol. Pharmacol. 58:380-3871; and c-myc [Giles (1999) Antisense Acid Drug Dev. 9:213-2201.

For example, interleukin 5 and its receptor play a critical role as regulators of hematopoiesis and as mediators in some inflammatory diseases such as allergy and asthma. Two alternatively spliced isoforms are generated from the IL-5R gene, which include (i.e., long form) or exclude (i.e., short form) exon 9. The long form encodes for the intact membrane-bound receptor, while the shorter form encodes for a secreted soluble non-functional receptor. Using 2'-O-MOE-oligonucleotides specific to regions of exon 9, Karras and co-workers (supra) were able to significantly decrease the expression of the wild type receptor and increase the expression of the shorter isoforms. Design and synthesis of oligonucleotides which can be used according to the present invention are described hereinbelow and by Sazani and Kole (2003) Progress in Moleclular and Subcellular Biology 31:217-239.

Treatment can preferably effected by agents which are capable of specifically downregulating expression (or activity) of at least one of the polypeptide variants of the present invention.

Down regulating the expression of the therapeutic protein variants of the present invention may be achieved using oligonucleotide agents such as those described in greater detail below.

SiRNA molecules—Small interfering RNA (siRNA) molecules can be used to down-regulate expression of the therapeutic protein variants of the present invention.

RNA interference is a two-step process. The first step, which is termed as the initiation step, input dsRNA is digested into 21-23 nucleotide (nt) small interfering RNAs (siRNA), probably by the action of Dicer, a member of the RNase III family of dsRNA-specific ribonucleases, which processes (cleaves) dsRNA (introduced directly or via a transgene or a virus) in an ATP-dependent manner. Successive cleavage events degrade the RNA to 19-21 bp duplexes (siRNA), each with 2-nucleotide 3' overhangs [Hutvagner and Zamore Curr. Opin. Genetics and Development 12:225-232 (2002); and Bernstein Nature 409:363-366 (2001)].

In the effector step, the siRNA duplexes bind to a nuclease complex to from the RNA-induced silencing complex (RISC). An ATP-dependent unwinding of the siRNA duplex is required for activation of the RISC. The active RISC then targets the homologous transcript by base pairing interactions and cleaves the mRNA into 12 nucleotide fragments from the 3' terminus of the siRNA [Hutvagner and Zamore Curr. Opin. Genetics and Development 12:225-232 (2002); Hammond et al. (2001) Nat. Rev. Gen. 2:110-119 (2001); and Sharp Genes. Dev. 15:485-90 (2001)]. Although the mechanism of cleavage is still to be elucidated, research indicates that each RISC contains a single siRNA and an RNase [Hutvagner and Zamore Curr. Opin. Genetics and Development 12:225-232 (2002)].

Because of the remarkable potency of RNAi, an amplification step within the RNAi pathway has been suggested. Amplification could occur by copying of the input dsRNAs which would generate more siRNAs, or by replication of the siRNAs formed. Alternatively or additionally, amplification could be effected by multiple turnover events of the RISC [Hammond et al. Nat. Rev. Gen. 2:110-119 (2001), Sharp Genes. Dev. 15:485-90 (2001); Hutvagner and Zamore Curr. Opin. Genetics and Development 12:225-232 (2002)]. For more information on RNAi see the following reviews Tuschl ChemBiochem. 2:239-245 (2001); Cullen Nat. Immunol. 3:597-599 (2002); and Brantl Biochem. Biophys. Act. 1575: 15-25 (2002).

Synthesis of RNAi molecules suitable for use with the present invention can be effected as follows. First, the mRNA sequence is scanned downstream of the AUG start codon for AA dinucleotide sequences. Occurrence of each AA and the 3' adjacent 19 nucleotides is recorded as potential siRNA target sites. Preferably, siRNA target sites are selected from the open reading frame, as untranslated regions (UTRs) are richer in regulatory protein binding sites. UTR-binding proteins and/or translation initiation complexes may interfere with binding of the siRNA endonuclease complex [Tuschl ChemBiochem. 2:239-245]. It will be appreciated though, that siRNAs directed at untranslated regions may also be effective, as demonstrated for GAPDH wherein siRNA directed at the 5' UTR mediated about 90% decrease in cellular GAPDH mRNA and completely abolished protein level.

Second, potential target sites are compared to an appropriate genomic database (e.g., human, mouse, rat etc.) using any sequence alignment software, such as the BLAST software available from the NCBI server. Putative target sites which exhibit significant homology to other coding sequences are filtered out. Qualifying target sequences are selected as template for siRNA synthesis.

Preferred sequences are those including low G/C content as these have proven to be more effective in mediating gene silencing as compared to those with G/C content higher than 55%. Several target sites are preferably selected along the length of the target gene for evaluation. Target sites are selected from the unique nucleotide sequences of each of the polynucleotides of the present invention, such that each polynucleotide is specifically down regulated. For better evaluation of the selected siRNAs, a negative control is preferably used in conjunction. Negative control siRNA preferably include the same nucleotide composition as the siRNAs but lack significant homology to the genome. Thus, a scrambled nucleotide sequence of the siRNA is preferably used, provided it does not display any significant homology to any other gene.

DNAzyme molecules—Another agent capable of down-regulating expression of the polypeptides of the present invention is a DNAzyme molecule capable of specifically cleaving an mRNA transcript or DNA sequence of the polynucleotides of the present invention. DNAzymes are single-stranded polynucleotides which are capable of cleaving both single and double stranded target sequences (Breaker, R. R. and Joyce, G. Chemistry and Biology 1995; 2:655; Santoro, S. W. & Joyce, G. F. Proc. Natl, Acad. Sci. USA 1997; 943: 4262) A general model (the "10-23" model) for the DNAzyme has been proposed. "10-23" DNAzymes have a catalytic domain of 15 deoxyribonucleotides, flanked by two substrate-recognition domains of seven to nine deoxyribonucleotides each. This type of DNAzyme can effectively cleave its substrate RNA at purine:pyrimidine junctions (Santoro, S. W. & Joyce, G. F. Proc. Natl, Acad. Sci. USA 199; for rev of DNAzymes see Khachigian, L M [Curr Opin Mol Ther 4:119-21 (2002)].

Target sites for DNAzymes are selected from the unique nucleotide sequences of each of the polynucleotides of the present invention, such that each polynucleotide is specifically down regulated.

Examples of construction and amplification of synthetic, engineered DNAzymes recognizing single and double-stranded target cleavage sites have been disclosed in U.S. Pat. No. 6,326,174 to Joyce et al. DNAzymes of similar design directed against the human Urokinase receptor were recently observed to inhibit Urokinase receptor expression, and successfully inhibit colon cancer cell metastasis in vivo (Itoh et al, 20002, Abstract 409, Ann Meeting Am Soc Gen Ther). In another application, DNAzymes complementary to bcr-abl oncogenes were successful in inhibiting the oncogenes expression in leukemia cells, and lessening relapse rates in autologous bone marrow transplant in cases of CML and ALL.

Antisense molecules—Downregulation of the polynucleotides of the present invention can also be effected by using an antisense polynucleotide capable of specifically hybridizing with an mRNA transcript encoding the polypeptide variants of the present invention.

The term "antisense", as used herein, refers to any composition containing nucleotide sequences, which are complementary to a specific DNA or RNA sequence.

The term "antisense strand" is used in reference to a nucleic acid strand that is complementary to the "sense" strand. Antisense molecules also include peptide nucleic acids and may be produced by any method including synthesis or transcription. Once introduced into a cell, the complementary nucleotides combine with natural sequences produced by the cell to form duplexes and block either transcription or translation. The designation "negative" is sometimes used in reference to the antisense strand, and "positive" is sometimes used in reference to the sense strand. Antisense oligonucleotides are also used for modulation of alternative splicing in vivo and for diagnostics in vivo and in vitro (Khelifi C. et al., 2002, Current Pharmaceutical Design 8:451-1466; Sazani, P., and Kole. R. Progress in Molecular and Cellular Biology, 2003, 31:217-239).

Design of antisense molecules which can be used to efficiently down-regulate expression of the polypeptides of the present invention must be effected while considering two aspects important to the antisense approach. The first aspect is delivery of the oligonucleotide into the cytoplasm of the appropriate cells, while the second aspect is design of an oligonucleotide which specifically binds the designated mRNA within cells in a way which inhibits translation thereof.

The prior art teaches of a number of delivery strategies which can be used to efficiently deliver oligonucleotides into a wide variety of cell types [see, for example, Luft J Mol Med 76: 75-6 (1998); Kronenwett et al. Blood 91: 852-62 (1998); Rajur et al. Bioconjug Chem 8: 935-40 (1997); Lavigne et al. Biochem Biophys Res Commun 237: 566-71 (1997) and Aoki et al. (1997) Biochem Biophys Res Commun 231: 540-5 (1997)].

In addition, algorithms for identifying those sequences with the highest predicted binding affinity for their target mRNA based on a thermodynamic cycle that accounts for the energetics of structural alterations in both the target mRNA and the oligonucleotide are also available [see, for example, Walton et al. Biotechnol Bioeng 65: 1-9 (1999)].

Such algorithms have been successfully used to implement an antisense approach in cells. For example, the algorithm developed by Walton et al. enabled scientists to successfully design antisense oligonucleotides for rabbit beta-globin (RBG) and mouse tumor necrosis factor-alpha (TNF alpha) transcripts. The same research group has more recently reported that the antisense activity of rationally selected oligonucleotides against three model target mRNAs (human lactate dehydrogenase A and B and rat gp130) in cell culture as evaluated by a kinetic PCR technique proved effective in almost all cases, including tests against three different targets in two cell types with phosphodiester and phosphorothioate oligonucleotide chemistries.

In addition, several approaches for designing and predicting efficiency of specific oligonucleotides using an in vitro system were also published (Matveeva et al., Nature Biotechnology 16: 1374-1375 (1998)].

Several clinical trials have demonstrated safety, feasibility and activity of antisense oligonucleotides. For example, antisense oligonucleotides suitable for the treatment of cancer have been successfully used [Holmund et al., Curr Opin Mol Ther 1:372-85 (1999)], while treatment of hematological malignancies via antisense oligonucleotides targeting c-myb gene, p53 and Bcl-2 had entered clinical trials and had been shown to be tolerated by patients [Gerwitz Curr Opin Mol Ther 1:297-306 (1999)].

More recently, antisense-mediated suppression of human heparanase gene expression has been reported to inhibit pleural dissemination of human cancer cells in a mouse model [Uno et al., Cancer Res 61:7855-60 (2001)].

Thus, the current consensus is that recent developments in the field of antisense technology which, as described above, have led to the generation of highly accurate antisense design algorithms and a wide variety of oligonucleotide delivery systems, enable an ordinarily skilled artisan to design and implement antisense approaches suitable for downregulating expression of known sequences without having to resort to undue trial and error experimentation.

Target sites for antisense molecules are selected from the unique nucleotide sequences of each of the polynucleotides of the present invention, such that each polynucleotide is specifically down regulated.

Ribozymes—Another agent capable of downregulating expression of the polypeptides of the present invention is a ribozyme molecule capable of specifically cleaving an mRNA transcript encoding the polypeptide variants of the present invention. Ribozymes are being increasingly used for the sequence-specific inhibition of gene expression by the cleavage of mRNAs encoding proteins of interest [Welch et al., Curr Opin Biotechnol. 9:486-96 (1998)]. The possibility of designing ribozymes to cleave any specific target RNA has rendered them valuable tools in both basic research and therapeutic applications. In therapeutics area, ribozymes have been exploited to target viral RNAs in infectious diseases, dominant oncogenes in cancers and specific somatic mutations in genetic disorders [Welch et al., Clin Diagn Virol. 10:163-71 (1998)]. Most notably, several ribozyme gene therapy protocols for HIV patients are already in Phase 1 trials. More recently, ribozymes have been used for transgenic animal research, gene target validation and pathway elucidation. Several ribozymes are in various stages of clinical trials. ANGIOZYME was the first chemically synthesized ribozyme to be studied in human clinical trials. ANGIOZYME specifically inhibits formation of the VEGF-r (Vascular Endothelial Growth Factor receptor), a key component in the angiogenesis pathway. Ribozyme Pharmaceuticals, Inc., as well as other firms have demonstrated the importance of anti-angiogenesis therapeutics in animal models. HEPTAZYME, a ribozyme designed to selectively destroy Hepatitis C Virus (HCV) RNA, was found effective in decreasing Hepatitis C viral RNA in cell culture assays (Ribozyme Pharmaceuticals, Incorporated—WEB home page).

An additional method of regulating the expression of a specific gene in cells is via triplex forming oligonucleotides (TFOs). Recent studies have shown that TFOs can be designed which can recognize and bind to polypurine/polypirimidine regions in double-stranded helical DNA in a sequence-specific manner. These recognition rules are outlined by Maher III, L. J., et al., Science, 1989; 245:725-730; Moser, H. E., et al., Science, 1987; 238:645-630; Beal, P. A., et al, Science, 1992; 251:1360-1363; Cooney, M., et al., Science, 1988; 241:456-459; and Hogan, M. E., et al., EP Publication 375408. Modification of the oligonucleotides, such as the introduction of intercalators and backbone substitutions, and optimization of binding conditions (pH and cation concentration) have aided in overcoming inherent obstacles to TFO activity such as charge repulsion and instability, and it was recently shown that synthetic oligonucleotides can be targeted to specific sequences (for a recent review see Seidman and Glazer, J Clin Invest 2003; 112:487-94).

In general, the triplex-forming oligonucleotide has the sequence correspondence:

| oligo | 3'--A | G | G | T |
|-------|-------|---|---|---|
| duplex | 5'--A | G | C | T |
| duplex | 3'--T | C | G | A |

However, it has been shown that the A-AT and G-GC triplets have the greatest triple helical stability (Reither and Jeltsch, BMC Biochem, 2002, Sep. 12, Epub). The same authors have demonstrated that TFOs designed according to the A-AT and G-GC rule do not form non-specific triplexes, indicating that the triplex formation is indeed sequence specific.

Thus for any given sequence in the gene regulatory region a triplex forming sequence may be devised. Triplex-forming oligonucleotides preferably are at least 15, more preferably 25, still more preferably 30 or more nucleotides in length, up to 50 or 100 bp.

Transfection of cells (for example, via cationic liposomes) with TFOs, and formation of the triple helical structure with the target DNA induces steric and functional changes, blocking transcription initiation and elongation, allowing the introduction of desired sequence changes in the endogenous DNA and resulting in the specific downregulation of gene expression. Examples of such suppression of gene expression in cells treated with TFOs include knockout of episomal supFG1 and endogenous HPRT genes in mammalian cells (Vasquez et al., Nucl Acids Res. 1999; 27:1176-81, and Puri, et al, J Biol Chem, 2001; 276:28991-98), and the sequence- and target specific downregulation of expression of the Ets2 transcription factor, important in prostate cancer etiology (Carbone, et al, Nucl Acid Res. 2003; 31:833-43), and the pro-inflammatory ICAM-1 gene (Besch et al, J Biol Chem, 2002; 277:32473-79). In addition, Vuyisich and Beal have recently shown that sequence specific TFOs can bind to dsRNA, inhibiting activity of dsRNA-dependent enzymes such as RNA-dependent kinases (Vuyisich and Beal, Nuc. Acids Res 2000; 28:2369-74).

Additionally, TFOs designed according to the abovementioned principles can induce directed mutagenesis capable of effecting DNA repair, thus providing both downregulation and upregulation of expression of endogenous genes (Seidman and Glazer, J Clin Invest 2003; 112:487-94). Detailed description of the design, synthesis and administration of effective TFOs can be found in U.S. Patent Application Nos. 2003 017068 and 2003 0096980 to Froehler et al, and 2002 0128218 and 2002 0123476 to Emanuele et al, and U.S. Pat. No. 5,721,138 to Lawn.

Alternatively, down regulation of the polypeptide variants of the present invention may be achieved at the polypeptide level using downregulating agents such as antibodies or antibody fragments capable of specifically binding the polypeptides of the present invention and inhibiting the activity thereof (i.e., neutralizing antibodies). Such antibodies can be directed for example, to the heterodimerizing domain on the variant, or to a putative ligand binding domain. Further description of antibodies and methods of generating same is provided below.

Alternatively, down regulation of the polypeptide variants of the present invention may be achieved using small, unique peptide sequences (e.g., of about 50-100 amino acids) which are capable of specifically binding to their target molecules (e.g., a receptor subunit) and thus prevent endogenous subunit assembly or association and therefore antagonize the receptor activity. Such peptides can be natural or synthetic peptides which are derived from the polypeptide of the present invention (e.g., SEQ ID NO:9, 77 or 164).

Pharmaceutical Compositions and Delivery Thereof

The present invention features a pharmaceutical composition comprising a therapeutically effective amount of a therapeutic agent according to the present invention, which is preferably a therapeutic protein variant as described herein. Optionally and alternatively, the therapeutic agent could be an antibody or an oligonucleotide that specifically recognizes and binds to the therapeutic protein variant, but not to the corresponding full length known protein.

Alternatively, the pharmaceutical composition of the present invention includes a therapeutically effective amount of at least an active portion of a therapeutic protein variant polypeptide.

The pharmaceutical composition according to the present invention is preferably used for the treatment of cluster or protein-related disease, disorder or condition.

"Treatment" refers to both therapeutic treatment and prophylactic or preventative measures. Those in need of treatment include those already with the disorder as well as those in which the disorder is to be prevented. Hence, the mammal to be treated herein may have been diagnosed as having the disorder or may be predisposed or susceptible to the disorder. "Mammal" for purposes of treatment refers to any animal classified as a mammal, including humans, domestic and farm animals, and zoo, sports, or pet animals, such as dogs, horses, cats, cows, etc. Preferably, the mammal is human.

A "disorder" is any condition that would benefit from treatment with the agent according to the present invention. This includes chronic and acute disorders or diseases including those pathological conditions which predispose the mammal to the disorder in question. Non-limiting examples of disorders to be treated herein are described with regard to specific examples given herein.

The term "therapeutically effective amount" refers to an amount of agent according to the present invention that is effective to treat a disease or disorder in a mammal. In the case of cancer, the therapeutically effective amount of the agent may reduce the number of cancer cells; reduce the tumor size; inhibit (i.e., slow to some extent and preferably stop) cancer cell infiltration into peripheral organs; inhibit (i.e., slow to some extent and preferably stop) tumor metastasis; inhibit, to some extent, tumor growth; and/or relieve to some extent one or more of the symptoms associated with the cancer. To the extent the agent may prevent growth and/or kill existing cancer cells, it may be cytostatic and/or cytotoxic. For cancer therapy, efficacy can, for example, be measured by assessing the time to disease progression (TTP) and/or determining the response rate (RR).

The therapeutic agents of the present invention can be provided to the subject per se, or as part of a pharmaceutical composition where they are mixed with a pharmaceutically acceptable carrier.

As used herein a "pharmaceutical composition" refers to a preparation of one or more of the active ingredients described herein with other chemical components such as physiologically suitable carriers and excipients. The purpose of a pharmaceutical composition is to facilitate administration of a compound to an organism.

Herein the term "active ingredient" refers to the preparation accountable for the biological effect.

Hereinafter, the phrases "physiologically acceptable carrier" and "pharmaceutically acceptable carrier" which may be interchangeably used refer to a carrier or a diluent that does not cause significant irritation to an organism and does not abrogate the biological activity and properties of the administered compound. An adjuvant is included under these phrases. One of the ingredients included in the pharmaceutically acceptable carrier can be for example polyethylene glycol (PEG), a biocompatible polymer with a wide range of solubility in both organic and aqueous media (Mutter et al. (1979).

Herein the term "excipient" refers to an inert substance added to a pharmaceutical composition to further facilitate administration of an active ingredient. Examples, without limitation, of excipients include calcium carbonate, calcium phosphate, various sugars and types of starch, cellulose derivatives, gelatin, vegetable oils and polyethylene glycols.

Techniques for formulation and administration of drugs may be found in "Remington's Pharmaceutical Sciences," Mack Publishing Co., Easton, Pa., latest edition, which is incorporated herein by reference.

Suitable routes of administration may, for example, include oral, rectal, transmucosal, especially transnasal, intestinal or parenteral delivery, including intramuscular, subcutaneous and intramedullary injections as well as intrathecal, direct intraventricular, intravenous, intraperitoneal, intranasal, or intraocular injections. Alternately, one may administer a preparation in a local rather than systemic manner, for example, via injection of the preparation directly into a specific region of a patient's body.

Pharmaceutical compositions of the present invention may be manufactured by processes well known in the art, e.g., by means of conventional mixing, dissolving, granulating, dragee-making, levigating, emulsifying, encapsulating, entrapping or lyophilizing processes.

Pharmaceutical compositions for use in accordance with the present invention may be formulated in conventional manner using one or more physiologically acceptable carriers comprising excipients and auxiliaries, which facilitate processing of the active ingredients into preparations which, can be used pharmaceutically. Proper formulation is dependent upon the route of administration chosen.

For injection, the active ingredients of the invention may be formulated in aqueous solutions, preferably in physiologically compatible buffers such as Hank's solution, Ringer's solution, or physiological salt buffer. For transmucosal administration, penetrants appropriate to the barrier to be permeated are used in the formulation. Such penetrants are generally known in the art.

For oral administration, the compounds can be formulated readily by combining the active compounds with pharmaceutically acceptable carriers well known in the art. Such carriers enable the compounds of the invention to be formulated as tablets, pills, dragees, capsules, liquids, gels, syrups, slurries, suspensions, and the like, for oral ingestion by a patient. Pharmacological preparations for oral use can be made using a solid excipient, optionally grinding the resulting mixture, and processing the mixture of granules, after adding suitable auxiliaries if desired, to obtain tablets or dragee cores. Suitable excipients are, in particular, fillers such as sugars, including lactose, sucrose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carbomethyl-cellulose; and/or physiologically acceptable polymers such as polyvinylpyrrolidone (PVP). If desired, disintegrating agents may be added, such as cross-linked polyvinyl pyrrolidone, agar, or alginic acid or a salt thereof such as sodium alginate.

Dragee cores are provided with suitable coatings. For this purpose, concentrated sugar solutions may be used which may optionally contain gum arabic, talc, polyvinyl pyrrolidone, carbopol gel, polyethylene glycol, titanium dioxide, lacquer solutions and suitable organic solvents or solvent mixtures. Dyestuffs or pigments may be added to the tablets or dragee coatings for identification or to characterize different combinations of active compound doses.

Pharmaceutical compositions, which can be used orally, include push-fit capsules made of gelatin as well as soft, sealed capsules made of gelatin and a plasticizer, such as glycerol or sorbitol. The push-fit capsules may contain the active ingredients in admixture with filler such as lactose, binders such as starches, lubricants such as talc or magnesium stearate and, optionally, stabilizers. In soft capsules, the active ingredients may be dissolved or suspended in suitable liquids, such as fatty oils, liquid paraffin, or liquid polyethylene glycols. In addition, stabilizers may be added. All formulations for oral administration should be in dosages suitable for the chosen route of administration.

For buccal administration, the compositions may take the form of tablets or lozenges formulated in conventional manner.

For administration by nasal inhalation, the active ingredients for use according to the present invention are conveniently delivered in the form of an aerosol spray presentation from a pressurized pack or a nebulizer with the use of a suitable propellant, e.g., dichlorodifluoromethane, trichlorofluoromethane, dichloro-tetrafluoroethane or carbon dioxide. In the case of a pressurized aerosol, the dosage unit may be determined by providing a valve to deliver a metered amount. Capsules and cartridges of, e.g., gelatin for use in a dispenser may be formulated containing a powder mix of the compound and a suitable powder base such as lactose or starch.

The preparations described herein may be formulated for parenteral administration, e.g., by bolus injection or continuous infusion. Formulations for injection may be presented in unit dosage form, e.g., in ampoules or in multidose containers with optionally, an added preservative. The compositions may be suspensions, solutions or emulsions in oily or aqueous vehicles, and may contain formulatory agents such as suspending, stabilizing and/or dispersing agents.

Pharmaceutical compositions for parenteral administration include aqueous solutions of the active preparation in water-soluble form. Additionally, suspensions of the active ingredients may be prepared as appropriate oily or water based injection suspensions. Suitable lipophilic solvents or vehicles include fatty oils such as sesame oil, or synthetic fatty acids esters such as ethyl oleate, triglycerides or liposomes. Aqueous injection suspensions may contain substances, which increase the viscosity of the suspension, such as sodium carboxymethyl cellulose, sorbitol or dextran. Optionally, the suspension may also contain suitable stabilizers or agents which increase the solubility of the active ingredients to allow for the preparation of highly concentrated solutions.

Alternatively, the active ingredient may be in powder form for constitution with a suitable vehicle, e.g., sterile, pyrogen-free water based solution, before use.

The preparation of the present invention may also be formulated in rectal compositions such as suppositories or retention enemas, using, e.g., conventional suppository bases such as cocoa butter or other glycerides.

Pharmaceutical compositions suitable for use in context of the present invention include compositions wherein the active ingredients are contained in an amount effective to achieve the intended purpose. More specifically, a therapeutically effective amount means an amount of active ingredients effective to prevent, alleviate or ameliorate symptoms of disease or prolong the survival of the subject being treated. Determination of a therapeutically effective amount is well within the capability of those skilled in the art.

For any preparation used in the methods of the invention, the therapeutically effective amount or dose can be estimated initially from in vitro assays. For example, a dose can be formulated in animal models and such information can be used to more accurately determine useful doses in humans.

Toxicity and therapeutic efficacy of the active ingredients described herein can be determined by standard pharmaceutical procedures in vitro, in cell cultures or experimental animals. The data obtained from these in vitro and cell culture assays and animal studies can be used in formulating a range of dosage for use in human.

The dosage may vary depending upon the dosage form employed and the route of administration utilized. The exact formulation, route of administration and dosage can be chosen by the individual physician in view of the patient's condition. (See e.g., Fingl, et al., 1975, in "The Pharmacological Basis of Therapeutics", Ch. 1 p. 1).

Depending on the severity and responsiveness of the condition to be treated, dosing can be of a single or a plurality of administrations, with course of treatment lasting from several days to several weeks or until cure is effected or diminution of the disease state is achieved.

The amount of a composition to be administered will, of course, be dependent on the subject being treated, the severity of the affliction, the manner of administration, the judgment of the prescribing physician, etc. Compositions including the preparation of the present invention formulated in a compatible pharmaceutical carrier may also be prepared, placed in an appropriate container, and labeled for treatment of an indicated condition.

Pharmaceutical compositions of the present invention may, if desired, be presented in a pack or dispenser device, such as an FDA approved kit, which may contain one or more unit dosage forms containing the active ingredient. The pack may, for example, comprise metal or plastic foil, such as a blister pack. The pack or dispenser device may be accompanied by instructions for administration. The pack or dispenser may also be accommodated by a notice associated with the container in a form prescribed by a governmental agency regulating the manufacture, use or sale of pharmaceuticals, which notice is reflective of approval by the agency of the form of the compositions or human or veterinary administration. Such notice, for example, may be of labeling approved by the U.S. Food and Drug Administration for prescription drugs or of an approved product insert.

Immunogenic Compositions

A therapeutic agent according to the present invention may optionally be a molecule, which promotes a specific immunogenic response against at least one of the polypeptides of the present invention in the subject. The molecule can be polypeptide variants of the present invention, a fragment derived therefrom or a nucleic acid sequence encoding thereof. Although such a molecule can be provided to the subject per se, the agent is preferably administered with an immunostimulant in an immunogenic composition. An immunostimulant may be any substance that enhances or potentiates an immune response (antibody and/or cell-mediated) to an exogenous antigen. Examples of immunostimulants include adjuvants, biodegradable microspheres (e.g., polylactic galactide) and liposomes into which the compound is incorporated (see e.g., U.S. Pat. No. 4,235,877). Vaccine preparation is generally described in, for example, M. F. Powell and M. J. Newman, eds., "Vaccine Design (the subunit and adjuvant approach)," Plenum Press (NY, 1995).

Illustrative immunogenic compositions may contain DNA encoding one or more of the polypeptides as described above, such that the polypeptide is generated in situ. The DNA may be present within any of a variety of delivery systems known to those of ordinary skill in the art, including nucleic acid expression systems (see below), bacteria and viral expression systems. Numerous gene delivery techniques are well known in the art, such as those described by Rolland, Crit. Rev. Therap. Drug Carrier Systems 15:143-198, 1998, and references cited therein. Appropriate nucleic acid expression systems contain the necessary DNA sequences for expression in the subject (such as a suitable promoter and terminating signal). Bacterial delivery systems involve the administration of a bacterium (such as *Bacillus-Calmette-Guerrin*) that expresses an immunogenic portion of the polypeptide on its cell surface or secretes such an epitope. In a preferred embodiment, the DNA may be introduced using a viral expression system (e.g., vaccinia or other pox virus, retrovirus, or adenovirus), which may involve the use of a non-pathogenic (defective), replication competent virus. Suitable systems are disclosed, for example, in Fisher-Hoch et al., Proc. Natl. Acad. Sci. USA 86:317-321, 1989; Flexner et al., Ann N.Y. Acad. Sci. 569:86-103, 1989; Flexner et al., Vaccine 8:17-21, 1990; U.S. Pat. Nos. 4,603,112, 4,769,330, and 5,017,487; WO 89/01973; U.S. Pat. No. 4,777,127; GB 2,200,651; EP 0,345,242; WO 91/02805; Berkner, Biotechniques 6:616-627, 1988; Rosenfeld et al., Science 252:431-434, 1991; Kolls et al., Proc. Natl. Acad. Sci. USA 91:215-219, 1994; Kass-Eisler et al., Proc. Natl. Acad. Sci. USA 90:11498-11502, 1993; Guzman et al., Circulation 88:2838-2848, 1993; and Guzman et al., Cir. Res. 73:1202-1207, 1993. Techniques for incorporating DNA into such expression systems are well known to those of ordinary skill in the art. The DNA may also be "naked," as described, for example, in Ulmer et al., Science 259:1745-1749, 1993 and reviewed by Cohen, Science 259:1691-1692, 1993. The uptake of naked DNA may be increased by coating the DNA onto biodegradable beads, which are efficiently transported into the cells.

It will be appreciated that an immunogenic composition may comprise both a polynucleotide and a polypeptide component. Such immunogenic compositions may provide for an enhanced immune response.

Any of a variety of immunostimulants may be employed in the immunogenic compositions of this invention. For example, an adjuvant may be included. Most adjuvants contain a substance designed to protect the antigen from rapid catabolism, such as aluminum hydroxide or mineral oil, and a stimulator of immune responses, such as lipid A, *Bortadella pertussis* or *Mycobacterium tuberculosis* derived proteins. Suitable adjuvants are commercially available as, for example, Freund's Incomplete Adjuvant and Complete Adjuvant (Difco Laboratories, Detroit, Mich.); Merck Adjuvant 65 (Merck and Company, Inc., Rahway, N.J.); AS-2 (SmithKline Beecham, Philadelphia, Pa.); aluminum salts such as aluminum hydroxide gel (alum) or aluminum phosphate; salts of calcium, iron or zinc; an insoluble suspension of acylated tyrosine; acylated sugars; cationically or anionically derivatized polysaccharides; polyphosphazenes; biodegradable microspheres; monophosphoryl lipid A and quil A. Cytokines, such as GM-CSF or interleukin-2, -7, or -12, may also be used as adjuvants.

The adjuvant composition may be designed to induce an immune response predominantly of the Th1 type. High levels of Th1-type cytokines (e.g., IFN-.gamma, TNF.alpha., IL-2 and IL-12) tend to favor the induction of cell mediated immune responses to an administered antigen. In contrast, high levels of Th2-type cytokines (e.g., IL-4, IL-5, IL-6 and IL-10) tend to favor the induction of humoral immune responses. Following application of an immunogenic composition as provided herein, the subject will support an immune response that includes Th1- and Th2-type responses. The levels of these cytokines may be readily assessed using standard assays. For a review of the families of cytokines, see Mosmann and Coffinan, Ann Rev. Immunol. 7:145-173, 1989.

Preferred adjuvants for use in eliciting a predominantly Th1-type response include, for example, a combination of monophosphoryl lipid A, preferably 3-de-O-acylated monophosphoryl lipid A (3D-MPL), together with an aluminum salt. MPL adjuvants are available from Corixa Corporation (Seattle, Wash.; see U.S. Pat. Nos. 4,436,727; 4,877,611; 4,866,034 and 4,912,094). CpG-containing oligonucleotides (in which the CpG dinucleotide is unmethylated) also induce a predominantly Th1 response. Such oligonucleotides are well known and are described, for example, in WO 96/02555, WO 99/33488 and U.S. Pat. Nos. 6,008,200 and 5,856,462. Immunostimulatory DNA sequences are also described, for example, by Sato et al., Science 273:352, 1996. Another preferred adjuvant is a saponin, preferably QS21 (Aquila Biopharmaceuticals Inc., Framingham, Mass.), which may be used alone or in combination with other adjuvants. For example, an enhanced system involves the combination of a monophosphoryl lipid A and saponin derivative, such as the combination of QS21 and 3D-MPL as described in WO 94/00153, or a less reactogenic composition where the QS21 is quenched with cholesterol, as described in WO 96/33739. Other preferred formulations comprise an oil-in-water emulsion and tocopherol. A particularly potent adjuvant formulation involving QS21, 3D-MPL and tocopherol in an oil-in-water emulsion is described in WO 95/17210.

Other preferred adjuvants include Montanide ISA 720 (Seppic, France), SAF (Chiron, Calif., United States), ISCOMS (CSL), MF-59 (Chiron), the SBAS series of adjuvants (e.g., SBAS-2 or SBAS-4, available from SmithKline Beecham, Rixensart, Belgium), Detox (Corixa, Hamilton, Mont.), RC-529 (Corixa, Hamilton, Mont.) and other aminoalkyl glucosaminide 4-phosphates (AGPs), such as those described in pending U.S. patent application Ser. Nos. 08/853,826 and 09/074,720.

A delivery vehicle may be employed within the immunogenic composition of the present invention to facilitate production of an antigen-specific immune response that targets tumor cells. Delivery vehicles include antigen presenting cells (APCs), such as dendritic cells, macrophages, B cells, monocytes and other cells that may be engineered to be efficient APCs. Such cells may be genetically modified to increase the capacity for presenting the antigen, to improve activation and/or maintenance of the T cell response, to have anti-tumor effects per se and/or to be immunologically compatible with the receiver (i.e., matched HLA haplotype). APCs may generally be isolated from any of a variety of biological fluids and organs, including tumor and peritumoral tissues, and may be autologous, allogeneic, syngeneic or xenogeneic cells.

Dendritic cells are highly potent APCs (Banchereau and Steinman, Nature 392:245-251, 1998) and have been shown to be effective as a physiological adjuvant for eliciting prophylactic or therapeutic antitumor immunity (see Timmernan and Levy, Ann Rev. Med. 50:507-529, 1999). In general, dendritic cells may be identified based on their typical shape (stellate in situ, with marked cytoplasmic processes (dendrites) visible in vitro), their ability to take up, process and present antigens with high efficiency and their ability to activate naive T cell responses. Dendritic cells may, of course, be engineered to express specific cell-surface receptors or ligands that are not commonly found on dendritic cells in vivo or ex vivo, and such modified dendritic cells are contemplated by the present invention. As an alternative to dendritic cells, secreted vesicles antigen-loaded dendritic cells (called exosomes) may be used within an immunogenic composition (see Zitvogel et al., Nature Med. 4:594-600, 1998).

Dendritic cells and progenitors may be obtained from peripheral blood, bone marrow, tumor-infiltrating cells, peritumoral tissues-infiltrating cells, lymph nodes, spleen, skin, umbilical cord blood or any other suitable tissue or fluid. For example, dendritic cells may be differentiated ex vivo by adding a combination of cytokines such as GM-CSF, IL-4, IL-13 and/or TNF.alpha. to cultures of monocytes harvested from peripheral blood. Alternatively, CD34 positive cells harvested from peripheral blood, umbilical cord blood or bone marrow may be differentiated into dendritic cells by adding to the culture medium combinations of GM-CSF, IL-3, TNF.alpha., CD40 ligand, LPS, flt3 ligand and/or other compound(s) that induce differentiation, maturation and proliferation of dendritic cells.

Dendritic cells are categorized as "immature" and "mature" cells, which allows a simple way to discriminate between two well characterized phenotypes. Immature dendritic cells are characterized as APC with a high capacity for antigen uptake and processing, which correlates with the high expression of Fcγ receptor and mannose receptor. The mature phenotype is typically characterized by a lower expression of these markers, but a high expression of cell surface molecules responsible for T cell activation such as class I and class II MHC, adhesion molecules (e.g., CD54 and CD11) and costimulatory molecules (e.g., CD40, CD80, CD86 and 4-1BB).

APCs may generally be transfected with at least one polynucleotide encoding a polypeptide of the present invention, such that variant II, or an immunogenic portion thereof, is expressed on the cell surface. Such transfection may take place ex vivo, and a composition comprising such transfected cells may then be used for therapeutic purposes, as described herein. Alternatively, a gene delivery vehicle that targets a dendritic or other antigen presenting cell may be administered to the subject, resulting in transfection that occurs in vivo. In vivo and ex vivo transfection of dendritic cells, for example, may generally be performed using any methods known in the art, such as those described in WO 97/24447, or the gene gun approach described by Mahvi et al., Immunology and cell Biology 75:456-460, 1997. Antigen loading of dendritic cells may be achieved by incubating dendritic cells or progenitor cells with a polypeptide of the present invention, DNA (naked or within a plasmid vector) or RNA; or with antigen-expressing recombinant bacterium or viruses (e.g., vaccinia, fowlpox, adenovirus or lentivirus vectors). Prior to loading, the polypeptide may be covalently conjugated to an immunological partner that provides T cell help (e.g., a carrier molecule) such as described above. Alternatively, a dendritic cell may be pulsed with a non-conjugated immunological partner, separately or in the presence of the polypeptide.

Preferred embodiments of the present invention encompass novel naturally occurring secreted (i.e., extracellular) and non-secreted (i.e., intracellular or membranal) variants of genes and gene products, which, as is described in the Examples section which follows, play pivotal roles in disease onset and progression. As such these variants can be used for a wide range of diagnostic and/or therapeutic uses.

Diagnostic Methods

The term "marker" in the context of the present invention refers to a nucleic acid fragment, a peptide, or a polypeptide, which is differentially present in a sample taken from patients having or predisposed to a cluster or protein-related disease, disorder or condition as compared to a comparable sample taken from subjects who do not have a such a disease, disorder or condition.

The methods for detecting these markers have many applications. For example, one marker or combination of markers can be measured to differentiate between various types of cluster or protein-related disease, disorder or condition, and thus are useful as an aid in the accurate diagnosis of cluster or protein-related disease, disorder or condition in a patient. For example, one marker or combination of markers can be measured to differentiate between various types of lung cancers, such as small cell or non-small cell lung cancer, and further between non-small cell lung cancer types, such as adenocarcinomas, squamous cell and large cell carcinomas, and thus are useful as an aid in the accurate diagnosis of lung cancer in a patient. In another example, the present methods for detecting these markers can be applied to in vitro cluster or protein-related cancers cells or in vivo animal models for cluster or protein-related cancers to assay for and identify compounds that modulate expression of these markers.

The phrase "differentially present" refers to differences in the quantity of a marker present in a sample taken from patients having cluster or protein-related disease, disorder or condition as compared to a comparable sample taken from patients who do not have such disease, disorder or condition. For example, a nucleic acid fragment may optionally be differentially present between the two samples if the amount of the nucleic acid fragment in one sample is significantly different from the amount of the nucleic acid fragment in the other sample, for example as measured by hybridization and/or NAT-based assays. A polypeptide is differentially present between the two samples if the amount of the polypeptide in one sample is significantly different from the amount of the polypeptide in the other sample. It should be noted that if the marker is detectable in one sample and not detectable in the other, then such a marker can be considered to be differentially present. One of ordinary skill in the art could easily determine such relative levels of the markers; further guidance is provided below.

As used herein the phrase "diagnostic" means identifying the presence or nature of a pathologic condition. Diagnostic methods differ in their sensitivity and specificity. The "sensitivity" of a diagnostic assay is the percentage of diseased individuals who test positive (percent of "true positives"). Diseased individuals not detected by the assay are "false negatives." Subjects who are not diseased and who test negative in the assay are termed "true negatives." The "specificity" of a diagnostic assay is 1 minus the false positive rate, where the "false positive" rate is defined as the proportion of those without the disease who test positive. While a particular diagnostic method may not provide a definitive diagnosis of a condition, it suffices if the method provides a positive indication that aids in diagnosis.

The phrase "predisposition" used herein refers to the susceptibility to develop a disorder. A subject with a predisposition to develop a disorder is more likely to develop the disorder than a non-predisposed subject.

As used herein the phrase "diagnosing" refers to classifying a disease or a symptom, determining a severity of the disease, monitoring disease progression, forecasting an outcome of a disease and/or prospects of recovery. The term "detecting" may also optionally encompass any of the above.

Diagnosis of a disease according to the present invention can be effected by determining a level of a polynucleotide or a polypeptide of the present invention in a biological sample obtained from the subject, wherein the level determined can be correlated with predisposition to, or presence or absence of the disease.

As used herein "a biological sample" refers to a sample of tissue or fluid isolated from a subject, including but not limited to, for example, plasma, serum, spinal fluid, lymph fluid, the external sections of the skin, respiratory, intestinal, and genitourinary tracts, tears, saliva, sputum, milk, blood cells, tumors, neuronal tissue, organs, and also samples of in vivo cell culture constituents. It should be noted that a "biological sample obtained from the subject" may also optionally comprise a sample that has not been physically removed from the subject, as described in greater detail below.

As used herein, the term "level" refers to expression levels of RNA and/or protein or to DNA copy number of a marker of the present invention.

Typically the level of the marker in a biological sample obtained from the subject is different (i.e., increased or decreased) from the level of the same variant in a similar sample obtained from a healthy individual.

Numerous well known tissue or fluid collection methods can be utilized to collect the biological sample from the subject in order to determine the level of DNA, RNA and/or polypeptide of the variant of interest in the subject.

Examples include, but are not limited to, fine needle biopsy, needle biopsy, core needle biopsy and surgical biopsy (e.g., brain biopsy), and lavage. Regardless of the procedure employed, once a biopsy/sample is obtained the level of the variant can be determined and a diagnosis can thus be made.

Determining the level of the same variant in normal tissues of the same origin is preferably effected along-side to detect an elevated expression and/or amplification and/or a decreased expression, of the variant as opposed to the normal tissues.

A "test amount" of a marker refers to an amount of a marker in a subject's sample that is consistent with a diagnosis of a cluster or protein-related disease, disorder or condition related cancer or other UbCH10 related disease. A test amount can be either in absolute amount (e.g., microgram/ml) or a relative amount (e.g., relative intensity of signals).

A "control amount" of a marker can be any amount or a range of amounts to be compared against a test amount of a marker. For example, a control amount of a marker can be the amount of a marker in a patient which does not have the cluster or protein-related disease, disorder or condition. A control amount can be either in absolute amount (e.g., microgram/ml) or a relative amount (e.g., relative intensity of signals).

"Detect" refers to identifying the presence, absence or amount of the object to be detected.

A "label" includes any moiety or item detectable by spectroscopic, photo chemical, biochemical, immunochemical, or chemical means. For example, useful labels include $^{32}$P, $^{35}$S, fluorescent dyes, electron-dense reagents, enzymes (e.g., as commonly used in an ELISA), biotin-streptavidin, digoxigenin, haptens and proteins for which antisera or monoclonal antibodies are available, or nucleic acid molecules with a sequence complementary to a target. The label often generates a measurable signal, such as a radioactive, chromogenic, or fluorescent signal, that can be used to quantify the amount of bound label in a sample. The label can be incorporated in or attached to a primer or probe either covalently, or through ionic, van der Waals or hydrogen bonds, e.g., incorporation of radioactive nucleotides, or biotinylated nucleotides that are recognized by streptavidin. The label may be directly or indirectly detectable. Indirect detection can involve the binding of a second label to the first label, directly or indirectly. For example, the label can be the ligand of a binding partner, such as biotin, which is a binding partner for streptavidin, or a nucleotide sequence, which is the binding partner for a complementary sequence, to which it can specifically hybridize. The binding partner may itself be directly detectable, for example, an antibody may be itself labeled with a fluorescent molecule. The binding partner also may be indirectly detectable, for example, a nucleic acid having a complementary nucleotide sequence can be a part of a branched DNA molecule that is in turn detectable through hybridization with other labeled nucleic acid molecules (see, e.g., P. D. Fahrlander and A. Klausner, Bio/Technology 6:1165 (1988)). Quantitation of the signal is achieved by, e.g., scintillation counting, densitometry, or flow cytometry.

Exemplary detectable labels, optionally and preferably for use with immunoassays, include but are not limited to magnetic beads, fluorescent dyes, radiolabels, enzymes (e.g., horse radish peroxide, alkaline phosphatase and others commonly used in an ELISA), and calorimetric labels such as colloidal gold or colored glass or plastic beads. Alternatively, the marker in the sample can be detected using an indirect assay, wherein, for example, a second, labeled antibody is used to detect bound marker-specific antibody, and/or in a competition or inhibition assay wherein, for example, a monoclonal antibody which binds to a distinct epitope of the marker are incubated simultaneously with the mixture.

"Immunoassay" is an assay that uses an antibody to specifically bind an antigen. The immunoassay is characterized by the use of specific binding properties of a particular antibody to isolate, target, and/or quantify the antigen.

The phrase "specifically (or selectively) binds" to an antibody or "specifically (or selectively) immunoreactive with" when referring to a protein or peptide (or other epitope), refers to a binding reaction that is determinative of the presence of the protein in a heterogeneous population of proteins and other biologics. Thus, under designated immunoassay conditions, the specified antibodies bind to a particular protein at least two times greater than the background (non-specific signal) and do not substantially bind in a significant amount to other proteins present in the sample. Specific binding to an antibody under such conditions may require an antibody that is selected for its specificity for a particular protein. For example, polyclonal antibodies raised to seminal basic protein from specific species such as rat, mouse, or human can be selected to obtain only those polyclonal antibodies that are specifically immunoreactive with seminal basic protein and not with other proteins, except for polymorphic variants and alleles of seminal basic protein. This selection may be achieved by subtracting out antibodies that cross-react with seminal basic protein molecules from other species. A variety of immunoassay formats may be used to select antibodies specifically immunoreactive with a particular protein. For example, solid-phase ELISA immunoassays are routinely used to select antibodies specifically immunoreactive with a protein (see, e.g., Harlow & Lane, Antibodies, A Laboratory Manual (1988), for a description of immunoassay formats and conditions that can be used to determine specific immunoreactivity). Typically a specific or selective reaction will be at least twice background signal or noise and more typically more than 10 to 100 times background.

In another embodiment, this invention provides antibodies specifically recognizing the splice variants and polypeptide fragments thereof of this invention. Preferably such antibodies differentially recognize splice variants of the present invention but do not recognize a corresponding known protein (such known proteins are discussed with regard to their splice variants in the Examples below).

In another embodiment, this invention provides a method for detecting a splice variant according to the present invention in a biological sample, comprising: contacting a biological sample with an antibody specifically recognizing a splice variant according to the present invention under conditions whereby the antibody specifically interacts with the splice variant in the biological sample but do not recognize known corresponding proteins (wherein the known protein is discussed with regard to its splice variant(s) in the Examples below), and detecting the interaction; wherein the presence of an interaction correlates with the presence of a splice variant in the biological sample.

In another embodiment, this invention provides a method for detecting a splice variant nucleic acid sequences in a biological sample, comprising: hybridizing the isolated nucleic acid molecules or oligonucleotide fragments of at least about a minimum length to a nucleic acid material of a biological sample and detecting a hybridization complex; wherein the presence of a hybridization complex correlates with the presence of a splice variant nucleic acid sequence in the biological sample.

According to another embodiment of the present invention the detection of the splice variant nucleic acid sequences in the biological sample is effected by detecting at least one nucleic acid change within a nucleic acid material derived from the biological sample; wherein the presence of the at least one nucleic acid change correlates with the presence of a splice variant nucleic acid sequence in the biological sample.

According to the present invention, the splice variants described herein are non-limiting examples of markers for diagnosing the cluster or protein-related disease, disorder or condition. Each splice variant marker of the present invention can be used alone or in combination, for various uses, including but not limited to, prognosis, prediction, screening, early diagnosis, determination of progression, therapy selection and treatment monitoring of such a cancer, disease or pathology.

According to optional but preferred embodiments of the present invention, any marker according to the present invention may optionally be used alone or combination. Such a combination may optionally comprise a plurality of markers described herein, optionally including any subcombination of markers, and/or a combination featuring at least one other marker, for example a known marker. Furthermore, such a combination may optionally and preferably be used as described above with regard to determining a ratio between a quantitative or semi-quantitative measurement of any marker described herein to any other marker described herein, and/or any other known marker, and/or any other marker. With regard to such a ratio between any marker described herein (or a combination thereof) and a known marker, more preferably the known marker comprises the "known protein" as described in greater detail below with regard to each cluster or gene.

According to other preferred embodiments of the present invention, a splice variant protein or a fragment thereof, or a splice variant nucleic acid sequence or a fragment thereof, may be featured as a biomarker for detecting the cluster or protein-related disease, disorder or condition, such that a biomarker may optionally comprise any of the above.

Non-limiting examples of methods or assays are described below.

The present invention also relates to kits based upon such diagnostic methods or assays.

NAT Assays

Detection of a nucleic acid of interest in a biological sample may also optionally be effected by NAT-based assays, which involve nucleic acid amplification technology, such as PCR, or variations thereof (e.g., real-time PCR, RT-PCR and in situ RT-PCR).

As used herein, a "primer" defines an oligonucleotide which is capable of annealing to (hybridizing with) a target sequence, thereby creating a double stranded region which can serve as an initiation point for DNA synthesis under suitable conditions.

Amplification of a selected, or target, nucleic acid sequence may be carried out by a number of suitable methods. See generally Kwoh et al., 1990, Am. Biotechnol. Lab. 8:14. Numerous amplification techniques have been described and can be readily adapted to suit particular needs of a person of ordinary skill. Non-limiting examples of amplification techniques include polymerase chain reaction (PCR), ligase chain reaction (LCR), strand displacement amplification (SDA), transcription-based amplification, the q3 replicase system and NASBA (Kwoh et al., 1989, Proc. Natl. Acad. Sci. USA 86, 1173-1177; Lizardi et al., 1988, BioTechnology 6:1197-1202; Malek et al., 1994, Methods Mol. Biol., 28:253-260; and Sambrook et al., 1989, supra).

The terminology "amplification pair" (or "primer pair") refers herein to a pair of oligonucleotides (oligos) of the present invention, which are selected to be used together in amplifying a selected nucleic acid sequence by one of a number of types of amplification processes, preferably a polymerase chain reaction. Other types of amplification processes include ligase chain reaction, strand displacement amplification, or nucleic acid sequence-based amplification, as explained in greater detail below. As commonly known in the art, the oligos are designed to bind to a complementary sequence under selected conditions.

In one particular embodiment, amplification of a nucleic acid sample from a patient is amplified under conditions which favor the amplification of the most abundant differentially expressed nucleic acid. In one preferred embodiment, RT-PCR is carried out on an mRNA sample from a patient under conditions which favor the amplification of the most abundant mRNA. In another preferred embodiment, the amplification of the differentially expressed nucleic acids is carried out simultaneously. It will be realized by a person skilled in the art that such methods could be adapted for the detection of differentially expressed proteins instead of differentially expressed nucleic acid sequences.

The nucleic acid (i.e. DNA or RNA) for practicing the present invention may be obtained according to well known methods.

Oligonucleotide primers of the present invention may be of any suitable length, depending on the particular assay format and the particular needs and targeted genomes employed. Optionally, the oligonucleotide primers are at least 12 nucleotides in length, preferably between 15 and 24 molecules, and they may be adapted to be especially suited to a chosen nucleic acid amplification system. As commonly known in the art, the oligonucleotide primers can be designed by taking into consideration the melting point of hybridization thereof with its targeted sequence (Sambrook et al., 1989, Molecular Cloning—A Laboratory Manual, 2nd Edition, CSH Laboratories; Ausubel et al., 1989, in Current Protocols in Molecular Biology, John Wiley & Sons Inc., N.Y.).

It will be appreciated that antisense oligonucleotides may be employed to quantify expression of a splice isoform of interest. Such detection is effected at the pre-mRNA level. Essentially the ability to quantitate transcription from a splice site of interest can be effected based on splice site accessibility. Oligonucleotides may compete with splicing factors for the splice site sequences. Thus, low activity of the antisense oligonucleotide is indicative of splicing activity.

The polymerase chain reaction and other nucleic acid amplification reactions are well known in the art (various non-limiting examples of these reactions are described in greater detail below). The pair of oligonucleotides according to this aspect of the present invention are preferably selected to have compatible melting temperatures (Tm), e.g., melting temperatures which differ by less than that 7° C., preferably less than 5° C., more preferably less than 4° C., most preferably less than 3° C., ideally between 3° C. and 0° C.

Polymerase Chain Reaction (PCR): The polymerase chain reaction (PCR), as described in U.S. Pat. Nos. 4,683,195 and 4,683,202 to Mullis and Mullis et al., is a method of increasing the concentration of a segment of target sequence in a mixture of genomic DNA without cloning or purification. This technology provides one approach to the problems of low target sequence concentration. PCR can be used to directly increase the concentration of the target to an easily detectable level. This process for amplifying the target sequence involves the introduction of a molar excess of two oligonucleotide primers which are complementary to their respective strands of the double-stranded target sequence to the DNA mixture containing the desired target sequence. The mixture is denatured and then allowed to hybridize. Following hybridization, the primers are extended with polymerase so as to form complementary strands. The steps of denaturation, hybridization (annealing), and polymerase extension (elongation) can be repeated as often as needed, in order to obtain relatively high concentrations of a segment of the desired target sequence.

The length of the segment of the desired target sequence is determined by the relative positions of the primers with respect to each other, and, therefore, this length is a controllable parameter. Because the desired segments of the target sequence become the dominant sequences (in terms of concentration) in the mixture, they are the to be "PCR-amplified."

Ligase Chain Reaction (LCR or LAR): The ligase chain reaction [LCR; sometimes referred to as "Ligase Amplification Reaction" (LAR)] has developed into a well-recognized alternative method of amplifying nucleic acids. In LCR, four oligonucleotides, two adjacent oligonucleotides which uniquely hybridize to one strand of target DNA, and a complementary set of adjacent oligonucleotides, which hybridize to the opposite strand are mixed and DNA ligase is added to the mixture. Provided that there is complete complementarity at the junction, ligase will covalently link each set of hybridized molecules. Importantly, in LCR, two probes are ligated together only when they base-pair with sequences in the target sample, without gaps or mismatches. Repeated cycles of denaturation, and ligation amplify a short segment of DNA. LCR has also been used in combination with PCR to achieve enhanced detection of single-base changes: see for example Segev, PCT Publication No. WO9001069 A1 (1990). However, because the four oligonucleotides used in this assay can pair to form two short ligatable fragments, there is the potential for the generation of target-independent background signal. The use of LCR for mutant screening is limited to the examination of specific nucleic acid positions.

Self-Sustained Synthetic Reaction (3SR/NASBA): The self-sustained sequence replication reaction (3SR) is a transcription-based in vitro amplification system that can exponentially amplify RNA sequences at a uniform temperature. The amplified RNA can then be utilized for mutation detection. In this method, an oligonucleotide primer is used to add a phage RNA polymerase promoter to the 5' end of the sequence of interest. In a cocktail of enzymes and substrates that includes a second primer, reverse transcriptase, RNase H, RNA polymerase and ribo- and deoxyribonucleoside triphosphates, the target sequence undergoes repeated rounds of transcription, cDNA synthesis and second-strand synthesis to amplify the area of interest. The use of 3SR to detect mutations is kinetically limited to screening small segments of DNA (e.g., 200-300 base pairs).

Q-Beta (Qβ) Replicase: In this method, a probe which recognizes the sequence of interest is attached to the replicatable RNA template for Qβ replicase. A previously identified major problem with false positives resulting from the replication of unhybridized probes has been addressed through use of a sequence-specific ligation step. However, available thermostable DNA ligases are not effective on this RNA substrate, so the ligation must be performed by T4 DNA ligase at low temperatures (37 degrees C.). This prevents the use of high temperature as a means of achieving specificity as in the LCR, the ligation event can be used to detect a mutation at the junction site, but not elsewhere.

A successful diagnostic method must be very specific. A straight-forward method of controlling the specificity of nucleic acid hybridization is by controlling the temperature of the reaction. While the 3SR/NASBA, and Qβ systems are all able to generate a large quantity of signal, one or more of the enzymes involved in each cannot be used at high temperature (i.e., >55 degrees C.). Therefore the reaction temperatures cannot be raised to prevent non-specific hybridization of the probes. If probes are shortened in order to make them melt more easily at low temperatures, the likelihood of having more than one perfect match in a complex genome increases. For these reasons, PCR and LCR currently dominate the research field in detection technologies.

The basis of the amplification procedure in the PCR and LCR is the fact that the products of one cycle become usable templates in all subsequent cycles, consequently doubling the population with each cycle. The final yield of any such doubling system can be expressed as: $(1+X)^n=y$, where "X" is the mean efficiency (percent copied in each cycle), "n" is the number of cycles, and "y" is the overall efficiency, or yield of the reaction. If every copy of a target DNA is utilized as a template in every cycle of a polymerase chain reaction, then the mean efficiency is 100%. If 20 cycles of PCR are performed, then the yield will be $2^{20}$, or 1,048,576 copies of the starting material. If the reaction conditions reduce the mean efficiency to 85%, then the yield in those 20 cycles will be only $1.85^{20}$, or 220,513 copies of the starting material. In other words, a PCR running at 85% efficiency will yield only 21% as much final product, compared to a reaction running at 100% efficiency. A reaction that is reduced to 50% mean efficiency will yield less than 1% of the possible product.

In practice, routine polymerase chain reactions rarely achieve the theoretical maximum yield, and PCRs are usually run for more than 20 cycles to compensate for the lower yield. At 50% mean efficiency, it would take 34 cycles to achieve the million-fold amplification theoretically possible in 20, and at lower efficiencies, the number of cycles required becomes prohibitive. In addition, any background products that amplify with a better mean efficiency than the intended target will become the dominant products.

Also, many variables can influence the mean efficiency of PCR, including target DNA length and secondary structure, primer length and design, primer and dNTP concentrations, and buffer composition, to name but a few. Contamination of the reaction with exogenous DNA (e.g., DNA spilled onto lab surfaces) or cross-contamination is also a major consideration. Reaction conditions must be carefully optimized for each different primer pair and target sequence, and the process can take days, even for an experienced investigator. The laboriousness of this process, including numerous technical considerations and other factors, presents a significant drawback to using PCR in the clinical setting. Indeed, PCR has yet to penetrate the clinical market in a significant way. The same concerns arise with LCR, as LCR must also be optimized to use different oligonucleotide sequences for each target sequence. In addition, both methods require expensive equipment, capable of precise temperature cycling.

Many applications of nucleic acid detection technologies, such as in studies of allelic variation, involve not only detection of a specific sequence in a complex background, but also the discrimination between sequences with few, or single, nucleotide differences. One method of the detection of allele-specific variants by PCR is based upon the fact that it is difficult for Taq polymerase to synthesize a DNA strand when there is a mismatch between the template strand and the 3' end of the primer. An allele-specific variant may be detected by the use of a primer that is perfectly matched with only one of the possible alleles; the mismatch to the other allele acts to prevent the extension of the primer, thereby preventing the amplification of that sequence. This method has a substantial limitation in that the base composition of the mismatch influences the ability to prevent extension across the mismatch, and certain mismatches do not prevent extension or have only a minimal effect.

A similar 3'-mismatch strategy is used with greater effect to prevent ligation in the LCR. Any mismatch effectively blocks the action of the thermostable ligase, but LCR still has the drawback of target-independent background ligation products initiating the amplification. Moreover, the combination of PCR with subsequent LCR to identify the nucleotides at individual positions is also a clearly cumbersome proposition for the clinical laboratory.

The direct detection method according to various preferred embodiments of the present invention may be, for example a cycling probe reaction (CPR) or a branched DNA analysis.

When a sufficient amount of a nucleic acid to be detected is available, there are advantages to detecting that sequence directly, instead of making more copies of that target, (e.g., as in PCR and LCR). Most notably, a method that does not amplify the signal exponentially is more amenable to quantitative analysis. Even if the signal is enhanced by attaching multiple dyes to a single oligonucleotide, the correlation between the final signal intensity and amount of target is direct. Such a system has an additional advantage that the products of the reaction will not themselves promote further reaction, so contamination of lab surfaces by the products is not as much of a concern. Recently devised techniques have sought to eliminate the use of radioactivity and/or improve the sensitivity in automatable formats. Two examples are the "Cycling Probe Reaction" (CPR), and "Branched DNA" (bDNA).

Cycling probe reaction (CPR): The cycling probe reaction (CPR), uses a long chimeric oligonucleotide in which a central portion is made of RNA while the two termini are made of DNA. Hybridization of the probe to a target DNA and exposure to a thermostable RNase H causes the RNA portion to be digested. This destabilizes the remaining DNA portions of the duplex, releasing the remainder of the probe from the target DNA and allowing another probe molecule to repeat the process. The signal, in the form of cleaved probe molecules, accumulates at a linear rate. While the repeating process increases the signal, the RNA portion of the oligonucleotide is vulnerable to RNases that may carried through sample preparation.

Branched DNA: Branched DNA (bDNA), involves oligonucleotides with branched structures that allow each individual oligonucleotide to carry 35 to 40 labels (e.g., alkaline phosphatase enzymes). While this enhances the signal from a hybridization event, signal from non-specific binding is similarly increased.

The NAT assays of the present invention also include methods of detecting at least one nucleic acid change [e.g., a single nucleotide polymorphism (SNP] in the biological sample of the present invention.

The demand for tests which allow the detection of specific nucleic acid sequences and sequence changes is growing rapidly in clinical diagnostics. As nucleic acid sequence data for genes from humans and pathogenic organisms accumulates, the demand for fast, cost-effective, and easy-to-use tests for as yet mutations within specific sequences is rapidly increasing.

A handful of methods have been devised to scan nucleic acid segments for mutations or nucleic acid changes. One option is to determine the entire gene sequence of each test sample (e.g., a bacterial isolate). For sequences under approximately 600 nucleotides, this may be accomplished using amplified material (e.g., PCR reaction products). This avoids the time and expense associated with cloning the segment of interest. However, specialized equipment and highly trained personnel are required, and the method is too labor-intense and expensive to be practical and effective in the clinical setting.

In view of the difficulties associated with sequencing, a given segment of nucleic acid may be characterized on several other levels. At the lowest resolution, the size of the molecule can be determined by electrophoresis by comparison to a known standard run on the same gel. A more detailed picture of the molecule may be achieved by cleavage with combinations of restriction enzymes prior to electrophoresis, to allow construction of an ordered map. The presence of specific sequences within the fragment can be detected by hybridization of a labeled probe, or the precise nucleotide sequence can be determined by partial chemical degradation or by primer extension in the presence of chain-terminating nucleotide analogs.

Restriction fragment length polymorphism (RFLP): For detection of single-base differences between like sequences, the requirements of the analysis are often at the highest level of resolution. For cases in which the position of the nucleotide in question is known in advance, several methods have been developed for examining single base changes without direct sequencing. For example, if a mutation of interest happens to fall within a restriction recognition sequence, a change in the pattern of digestion can be used as a diagnostic tool (e.g., restriction fragment length polymorphism [RFLP] analysis).

Single point mutations have been also detected by the creation or destruction of RFLPs. Mutations are detected and localized by the presence and size of the RNA fragments generated by cleavage at the mismatches. Single nucleotide mismatches in DNA heteroduplexes are also recognized and cleaved by some chemicals, providing an alternative strategy to detect single base substitutions, generically named the "Mismatch Chemical Cleavage" (MCC). However, this method requires the use of osmium tetroxide and piperidine, two highly noxious chemicals which are not suited for use in a clinical laboratory.

RFLP analysis suffers from low sensitivity and requires a large amount of sample. When RFLP analysis is used for the detection of point mutations, it is, by its nature, limited to the detection of only those single base changes which fall within a restriction sequence of a known restriction endonuclease. Moreover, the majority of the available enzymes have 4 to 6 base-pair recognition sequences, and cleave too frequently for many large-scale DNA manipulations. Thus, it is applicable only in a small fraction of cases, as most mutations do not fall within such sites.

A handful of rare-cutting restriction enzymes with 8 base-pair specificities have been isolated and these are widely used in genetic mapping, but these enzymes are few in number, are limited to the recognition of G+C-rich sequences, and cleave at sites that tend to be highly clustered. Recently, endonucleases encoded by group I introns have been discovered that might have greater than 12 base-pair specificity, but again, these are few in number.

Allele specific oligonucleotide (ASO): If the change is not in a recognition sequence, then allele-specific oligonucleotides (ASOs), can be designed to hybridize in proximity to the mutated nucleotide, such that a primer extension or ligation event can bused as the indicator of a match or a mismatch. Hybridization with radioactively labeled allelic specific oligonucleotides (ASO) also has been applied to the detection of specific point mutations. The method is based on the differences in the melting temperature of short DNA fragments differing by a single nucleotide. Stringent hybridization and washing conditions can differentiate between mutant and wild-type alleles. The ASO approach applied to PCR products also has been extensively utilized by various researchers to detect and characterize point mutations in ras genes and gsp/gip oncogenes. Because of the presence of various nucleotide changes in multiple positions, the ASO method requires the use of many oligonucleotides to cover all possible oncogenic mutations.

With either of the techniques described above (i.e., RFLP and ASO), the precise location of the suspected mutation must be known in advance of the test. That is to say, they are inapplicable when one needs to detect the presence of a mutation within a gene or sequence of interest.

Denaturing/Temperature Gradient Gel Electrophoresis (DGGE/TGGE): Two other methods rely on detecting changes in electrophoretic mobility in response to minor sequence changes. One of these methods, termed "Denaturing Gradient Gel Electrophoresis" (DGGE) is based on the observation that slightly different sequences will display different patterns of local melting when electrophoretically resolved on a gradient gel. In this manner, variants can be distinguished, as differences in melting properties of homoduplexes versus heteroduplexes differing in a single nucleotide can detect the presence of mutations in the target sequences because of the corresponding changes in their electrophoretic mobilities. The fragments to be analyzed, usually PCR products, are "clamped" at one end by a long stretch of G-C base pairs (30-80) to allow complete denaturation of the sequence of interest without complete dissociation of the strands. The attachment of a GC "clamp" to the DNA fragments increases the fraction of mutations that can be recognized by DGGE. Attaching a GC clamp to one primer is critical to ensure that the amplified sequence has a low dissociation temperature. Modifications of the technique have been developed, using temperature gradients, and the method can be also applied to RNA:RNA duplexes.

Limitations on the utility of DGGE include the requirement that the denaturing conditions must be optimized for each type of DNA to be tested. Furthermore, the method requires specialized equipment to prepare the gels and maintain the needed high temperatures during electrophoresis. The expense associated with the synthesis of the clamping tail on one oligonucleotide for each sequence to be tested is also a major consideration. In addition, long running times are required for DGGE. The long running time of DGGE was shortened in a modification of DGGE called constant denaturant gel electrophoresis (CDGE). CDGE requires that gels be performed under different denaturant conditions in order to reach high efficiency for the detection of mutations.

A technique analogous to DGGE, termed temperature gradient gel electrophoresis (TGGE), uses a thermal gradient rather than a chemical denaturant gradient. TGGE requires the use of specialized equipment which can generate a temperature gradient perpendicularly oriented relative to the electrical field. TGGE can detect mutations in relatively small fragments of DNA therefore scanning of large gene segments requires the use of multiple PCR products prior to running the gel.

Single-Strand Conformation Polymorphism (SSCP): Another common method, called "Single-Strand Conformation Polymorphism" (SSCP) was developed by Hayashi, Sekya and colleagues and is based on the observation that single strands of nucleic acid can take on characteristic conformations in non-denaturing conditions, and these conformations influence electrophoretic mobility. The complementary strands assume sufficiently different structures that one strand may be resolved from the other. Changes in sequences within the fragment will also change the conformation, consequently altering the mobility and allowing this to be used as an assay for sequence variations.

The SSCP process involves denaturing a DNA segment (e.g., a PCR product) that is labeled on both strands, followed by slow electrophoretic separation on a non-denaturing polyacrylamide gel, so that intra-molecular interactions can form and not be disturbed during the run. This technique is extremely sensitive to variations in gel composition and temperature. A serious limitation of this method is the relative difficulty encountered in comparing data generated in different laboratories, under apparently similar conditions.

Dideoxy fingerprinting (ddF): The dideoxy fingerprinting (ddF) is another technique developed to scan genes for the presence of mutations. The ddF technique combines components of Sanger dideoxy sequencing with SSCP. A dideoxy sequencing reaction is performed using one dideoxy terminator and then the reaction products are electrophoresed on nondenaturing polyacrylamide gels to detect alterations in mobility of the termination segments as in SSCP analysis. While ddF is an improvement over SSCP in terms of increased sensitivity, ddF requires the use of expensive dideoxynucleotides and this technique is still limited to the analysis of fragments of the size suitable for SSCP (i.e., fragments of 200-300 bases for optimal detection of mutations).

In addition to the above limitations, all of these methods are limited as to the size of the nucleic acid fragment that can be analyzed. For the direct sequencing approach, sequences of greater than 600 base pairs require cloning, with the consequent delays and expense of either deletion sub-cloning or primer walking, in order to cover the entire fragment. SSCP and DGGE have even more severe size limitations. Because of reduced sensitivity to sequence changes, these methods are not considered suitable for larger fragments. Although SSCP is reportedly able to detect 90% of single-base substitutions within a 200 base-pair fragment, the detection drops to less than 50% for 400 base pair fragments. Similarly, the sensitivity of DGGE decreases as the length of the fragment reaches 500 base-pairs. The ddF technique, as a combination of direct sequencing and SSCP, is also limited by the relatively small size of the DNA that can be screened.

Reverse dot blot: This technique uses labeled sequence specific oligonucleotide probes and unlabeled nucleic acid samples. Activated primary amine-conjugated oligonucleotides are covalently attached to carboxylated nylon membranes. After hybridization and washing, the labeled probe, or a labeled fragment of the probe, can be released using oligomer restriction, i.e., the digestion of the duplex hybrid with a restriction enzyme. Circular spots or lines are visualized colorimetrically after hybridization through the use of streptavidin horseradish peroxidase incubation followed by development using tetramethylbenzidine and hydrogen peroxide, or via chemiluminescence after incubation with avidin alkaline phosphatase conjugate and a luminous substrate susceptible to enzyme activation, such as CSPD, followed by exposure to x-ray film.

It will be appreciated that advances in the field of SNP detection have provided additional accurate, easy, and inexpensive large-scale SNP genotyping techniques, such as Pyrosequencing™, Acycloprime™, dynamic allele-specific hybridization (DASH, Howell, W. M. et al., 1999. Dynamic allele-specific hybridization (DASH). Nat. Biotechnol. 17: 87-8), microplate array diagonal gel electrophoresis [MADGE, Day, I. N. et al., 1995. High-throughput genotyping using horizontal polyacrylamide gels with wells arranged for microplate array diagonal gel electrophoresis (MADGE). Biotechniques. 19: 830-5], the TaqMan system (Holland, P. M. et al., 1991. Detection of specific polymerase chain reaction product by utilizing the 5'→3' exonuclease activity of *Thermus aquaticus* DNA polymerase. Proc Natl Acad Sci USA. 88: 7276-80), as well as various DNA "chip" technologies such as the GeneChip microarrays (e.g., Affymetrix SNP chips) which are disclosed in U.S. Pat. No. 6,300,063 to Lipshutz, et al. 2001, which is fully incorporated herein by reference, Genetic Bit Analysis (GBA™) which is described by Goelet, P. et al. (PCT Appl. No. 92/15712), peptide nucleic acid (PNA, Ren B, et al., 2004. Nucleic Acids Res. 32: e42) and locked nucleic acids (LNA, Latorra D, et al., 2003. Hum. Mutat. 22: 79-85) probes, Molecular Beacons (Abravaya K, et al., 2003. Clin Chem Lab Med. 41: 468-74), intercalating dye [Germer, S. and Higuchi, R. Single-tube genotyping without oligonucleotide probes. Genome Res. 9:72-78 (1999)], FRET primers (Solinas A et al., 2001. Nucleic Acids Res. 29: E96), AlphaScreen (Beaudet L, et al., Genome Res. 2001, 11(4): 600-8), SNPstream (Bell P A, et al., 2002. Biotechniques. Suppl.: 70-2, 74, 76-7), Multiplex minisequencing (Curcio M, et al., 2002. Electrophoresis. 23: 1467-72), SnaPshot (Turner D, et al., 2002. Hum Immunol. 63: 508-13), MassEXTEND (Cashman J R, et al., 2001. Drug Metab Dispos. 29: 1629-37), GOOD assay (Sauer S, and Gut I G. 2003. Rapid Commun. Mass. Spectrom. 17: 1265-72), Microarray minisequencing (Liljedahl U, et al., 2003. Pharmacogenetics. 13: 7-17), arrayed primer extension (APEX) (Tonisson N, et al., 2000. Clin. Chem. Lab. Med. 38: 165-70), Microarray primer extension (O'Meara D, et al., 2002. Nucleic Acids Res. 30: e75), Tag arrays (Fan J B, et al., 2000. Genome Res. 10: 853-60), Template-directed incorporation (TDI) (Akula N, et al., 2002. Biotechniques. 32: 1072-8), fluorescence polarization (Hsu T M, et al., 2001. Biotechniques. 31: 560, 562, 564-8), Colorimetric oligonucleotide ligation assay (OLA, Nickerson D A, et al., 1990. Proc. Natl. Acad. Sci. USA. 87: 8923-7), Sequence-coded OLA (Gasparini P, et al., 1999. J. Med. Screen. 6: 67-9), Microarray ligation, Ligase chain reaction, Padlock probes, Rolling circle amplification, Invader assay (reviewed in Shi M M. 2001. Enabling large-scale pharmacogenetic studies by high-throughput mutation detection and genotyping technologies. Clin Chem. 47: 164-72), coded microspheres (Rao K V et al., 2003. Nucleic Acids Res. 31: e66) and MassArray (Leushner J, Chiu N H, 2000. Mol Diagn. 5: 341-80).

According to a presently preferred embodiment of the present invention the step of searching for any of the nucleic acid sequences described here, in tumor cells or in cells derived from a cancer patient is effected by any suitable technique, including, but not limited to, nucleic acid sequencing, polymerase chain reaction, ligase chain reaction, self-sustained synthetic reaction, QP-Replicase, cycling probe reaction, branched DNA, restriction fragment length polymorphism analysis, mismatch chemical cleavage, heteroduplex analysis, allele-specific oligonucleotides, denaturing gradient gel electrophoresis, constant denaturant gel electrophoresis, temperature gradient gel electrophoresis, dideoxy fingerprinting, Pyrosequencing™, Acycloprime™, and reverse dot blot.

Detection may also optionally be performed with a chip or other such device. The nucleic acid sample which includes the candidate region to be analyzed is preferably isolated, amplified and labeled with a reporter group. This reporter group can be a fluorescent group such as phycoerythrin. The labeled nucleic acid is then incubated with the probes immobilized on the chip using a fluidics station. For example, Manz et al. (1993) Adv in Chromatogr 1993; 33:1-66 describe the fabrication of fluidics devices and particularly microcapillary devices, in silicon and glass substrates.

Once the reaction is completed, the chip is inserted into a scanner and patterns of hybridization are detected. The hybridization data is collected, as a signal emitted from the reporter groups already incorporated into the nucleic acid, which is now bound to the probes attached to the chip. Since the sequence and position of each probe immobilized on the chip is known, the identity of the nucleic acid hybridized to a given probe can be determined.

Preferably, the detection of at least one nucleic acid change and/or the splice variant sequence of the present invention is effected in a biological sample containing RNA molecules using, for example, RT-PCR or in situ RT-PCR.

RT-PCR analysis: This method uses PCR amplification of relatively rare RNAs molecules. First, RNA molecules are purified from the cells and converted into complementary DNA (cDNA) using a reverse transcriptase enzyme (such as an MMLV-RT) and primers such as, oligo dT, random hexamers or gene specific primers. Then by applying gene specific primers and Taq DNA polymerase, a PCR amplification reaction is carried out in a PCR machine. Those of skills in the art are capable of selecting the length and sequence of the gene specific primers and the PCR conditions (i.e., annealing temperatures, number of cycles and the like) which are suitable for detecting specific RNA molecules. It will be appreciated that a semi-quantitative RT-PCR reaction can be employed by adjusting the number of PCR cycles and comparing the amplification product to known controls.

In situ RT-PCR stain: This method is described in Nuovo G J, et al. [Intracellular localization of polymerase chain reaction (PCR)-amplified hepatitis C cDNA. Am J Surg Pathol. 1993, 17: 683-90] and Komminoth P, et al. [Evaluation of methods for hepatitis C virus detection in archival liver biopsies. Comparison of histology, immunohistochemistry, in situ hybridization, reverse transcriptase polymerase chain reaction (RT-PCR) and in situ RT-PCR. Pathol Res Pract. 1994, 190: 1017-251. Briefly, the RT-PCR reaction is performed on fixed cells by incorporating labeled nucleotides to the PCR reaction. The reaction is carried on using a specific in situ RT-PCR apparatus such as the laser-capture microdissection PixCell I LCM system available from Arcturus Engineering (Mountainview, Calif.).

It will be appreciated that when utilized along with automated equipment, the above described detection methods can be used to screen multiple samples for a disease and/or pathological condition both rapidly and easily.

Additional objects, advantages, and novel features of the present invention will become apparent to one ordinarily skilled in the art upon examination of the following examples, which are not intended to be limiting. Additionally, each of the various embodiments and aspects of the present invention as delineated hereinabove and as claimed in the claims section below finds experimental support in the following examples.

EXAMPLES

Reference is now made to the following examples, which together with the above descriptions, illustrate the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for

Example 1

Description of the methodology undertaken to uncover the biomolecular sequences of the present invention and uses therefore.

Human ESTs and cDNAs were obtained from GenBank versions 136 (Jun. 15, 2003 ftp://ftp.ncbi.nih.gov/genbank/release.notes/gb136.release.notes) and NCBI genome assembly of April 2003. Novel splice variants were predicted using the LEADS clustering and assembly system as described in U.S. Pat. No. 6,625,545, U.S. patent application Ser. No. 10/426,002, both of which are hereby incorporated by reference as if fully set forth herein. Briefly, the software cleans the expressed sequences from repeats, vectors and immunoglobulins. It then aligns the expressed sequences to the genome taking alternatively splicing into account and clusters overlapping expressed sequences into "clusters" that represent genes or partial genes.

These were annotated using the GeneCarta (Compugen, Tel-Aviv, Israel) platform. The GeneCarta platform includes a rich pool of annotations, sequence information (particularly of spliced sequences), chromosomal information, alignments, and additional information such as SNPs, gene ontology terms, expression profiles, functional analyses, detailed domain structures, known and predicted proteins and detailed homology reports.

Brief description of the methodology used to obtain annotative sequence information is summarized infra (for detailed description see U.S. patent application Ser. No. 10/426,002, published as US20040101876 on May 27, 2004).

The ontological annotation approach—An ontology refers to the body of knowledge in a specific knowledge domain or discipline such as molecular biology, microbiology, immunology, virology, plant sciences, pharmaceutical chemistry, medicine, neurology, endocrinology, genetics, ecology, genomics, proteomics, cheminformatics, pharmacogenomics, bioinformatics, computer sciences, statistics, mathematics, chemistry, physics and artificial intelligence.

An ontology includes domain-specific concepts—referred to, herein, as sub-ontologies. A sub-ontology may be classified into smaller and narrower categories. The ontological annotation approach is effected as follows.

First, biomolecular (i.e., polynucleotide or polypeptide) sequences are computationally clustered according to a progressive homology range, thereby generating a plurality of clusters each being of a predetermined homology of the homology range.

Progressive homology is used to identify meaningful homologies among biomolecular sequences and to thereby assign new ontological annotations to sequences, which share requisite levels of homologies. Essentially, a biomolecular sequence is assigned to a specific cluster if displays a predetermined homology to at least one member of the cluster (i.e., single linkage). A "progressive homology range" refers to a range of homology thresholds, which progress via predetermined increments from a low homology level (e.g. 35%) to a high homology level (e.g. 99%).

Following generation of clusters, one or more ontologies are assigned to each cluster. Ontologies are derived from an annotation preassociated with at least one biomolecular sequence of each cluster; and/or generated by analyzing (e.g., text-mining) at least one biomolecular sequence of each cluster thereby annotating biomolecular sequences.

The hierarchical annotation approach—"Hierarchical annotation" refers to any ontology and subontology, which can be hierarchically ordered, such as, a tissue expression hierarchy, a developmental expression hierarchy, a pathological expression hierarchy, a cellular expression hierarchy, an intracellular expression hierarchy, a taxonomical hierarchy, a functional hierarchy and so forth.

The hierarchical annotation approach is effected as follows. First, a dendrogram representing the hierarchy of interest is computationally constructed. A "dendrogram" refers to a branching diagram containing multiple nodes and representing a hierarchy of categories based on degree of similarity or number of shared characteristics.

Each of the multiple nodes of the dendrogram is annotated by at least one keyword describing the node, and enabling literature and database text mining, such as by using publicly available text mining software. A list of keywords can be obtained from the GO Consortium. However, measures are taken to include as many keywords, and to include keywords which might be out of date. For example, for tissue annotation, a hierarchy is built using all available tissue/libraries sources available in the GenBank, while considering the following parameters: ignoring GenBank synonyms, building anatomical hierarchies, enabling flexible distinction between tissue types (normal versus pathology) and tissue classification levels (organs, systems, cell types, etc.).

In a second step, each of the biomolecular sequences is assigned to at least one specific node of the dendrogram.

The biomolecular sequences can be annotated biomolecular sequences, unannotated biomolecular sequences or partially annotated biomolecular sequences.

Annotated biomolecular sequences can be retrieved from pre-existing annotated databases as described hereinabove.

For example, in GenBank, relevant annotational information is provided in the definition and keyword fields. In this case, classification of the annotated biomolecular sequences to the dendrogram nodes is directly effected. A search for suitable annotated biomolecular sequences is performed using a set of keywords which are designed to classify the biomolecular sequences to the hierarchy (i.e., same keywords that populate the dendrogram).

In cases where the biomolecular sequences are unannotated or partially annotated, extraction of additional annotational information is effected prior to classification to dendrogram nodes. This can be effected by sequence alignment, as described hereinabove. Alternatively, annotational information can be predicted from structural studies. Where needed, nucleic acid sequences can be transformed to amino acid sequences to thereby enable more accurate annotational prediction.

Finally, each of the assigned biomolecular sequences is recursively classified to nodes hierarchically higher than the specific nodes, such that the root node of the dendrogram encompasses the full biomolecular sequence set, which can be classified according to a certain hierarchy, while the offspring of any node represent a partitioning of the parent set.

For example, a biomolecular sequence found to be specifically expressed in "rhabdomyosarcoma", will be classified also to a higher hierarchy level, which is "sarcoma", and then to "Mesenchymal cell tumors" and finally to a highest hierarchy level "Tumor". In another example, a sequence found to be differentially expressed in endometrium cells, will be classified also to a higher hierarchy level, which is "uterus", and then to "women genital system" and to "genital system" and finally to a highest hierarchy level "genitourinary system". The retrieval can be performed according to each one of the requested levels.

Annotating gene expression according to relative abundance—Spatial and temporal gene annotations are also assigned by comparing relative abundance in libraries of different origins. This approach can be used to find genes, which are differentially expressed in tissues, pathologies and different developmental stages. In principal, the presentation of a contigue in at least two tissues of interest is determined and significant over or under representation of the contigue in one of the at least two tissues is assessed to identify differential expression. Significant over or under representation is analyzed by statistical pairing.

Annotating spatial and temporal expression can also be effected on splice variants. This is effected as follows. First, a contigue which includes exonal sequence presentation of the at least two splice variants of the gene of interest is obtained. This contigue is assembled from a plurality of expressed sequences; Then, at least one contigue sequence region, unique to a portion (i.e., at least one and not all) of the at least two splice variants of the gene of interest, is identified. Identification of such unique sequence region is effected using computer alignment software. Finally, the number of the plurality of expressed sequences in the tissue having the at least one contigue sequence region is compared with the number of the plurality of expressed sequences not-having the at least one contigue sequence region, to thereby compare the expression level of the at least two splice variants of the gene of interest in the tissue.

Data concerning therapies, indications and possible pharmacological activities of the polypeptides of the present invention was obtained from PharmaProject (PJB Publications Ltd 2003) and public databases, including LocusLink and Swissprot). Functional structural analysis of the polypeptides of the present invention was effected using Interpro domain analysis software (Interpro default parameters, the analyses that were run are HMMPfam, HMMSmart, ProfileScan, FprintScan, and BlastProdom). Subecllular localization was analysed using ProLoc software (Einat Hazkani-Covo, Erez Y. Levanon, Galit Rotman, Dan Graur, Amit Novik. Evolution of multicellularity in metazoa: comparative analysis of the subcellular localization of proteins in *Saccharomyces*, *Drosophila* and *Caenorhabditis*. Cell Biology International (2004; 28(3): 171-8).

Identifying gene products by interspecies sequence comparison—The present inventors have designed and configured a method of predicting gene expression products based on interspecies sequence comparison. Specifically, the method is based on the identification of conserved alternatively spliced exons for which there might be no supportive expression data.

Alternatively spliced exons have unique characteristics differentiating them from constitutively spliced ones. Using machine-learning techniques a combination of such characteristics was elucidated that defines alternatively spliced exons with very high probability. Any human exon having this combination of characteristics is therefore predicted to be alternatively spliced. Using this method, the present inventors were able to detect putative splice variants that are not supported by human ESTs.

The method is effected as follows. First, alternatively spliced exons of a gene of interest are identified by scoring exon sequences of the gene of interest according to at least one sequence parameter as follows: (i) exon length—conserved alternatively spliced exons are relatively shorter than constitutively spliced ones; (ii) division by 3—alternatively spliced exons are cassette exons that are sometimes inserted and sometimes skipped; Since alternatively spliced exons frequently contain sequences that regulate their splicing important parameters for scoring alternatively spliced exons include (iii) conservation level to a non-human ortholohgous sequence; (iv) length of conserved intron sequences upstream of each of the exon sequences; (v) length of conserved intron sequences downstream of each of the exon sequences; (vi) conservation level of the intron sequences upstream of each of the exon sequences; and (vii) conservation level of the intron sequences downstream of each of the exon sequences.

Exon sequences scoring above a predetermined threshold represent alternatively spliced exons of the gene of interest.

Once alternatively spliced exons are identified, the chromosomal location of each of the alternatively spliced exons is analyzed with respect to coding sequence of the gene of interest to thereby predict expression products of the gene of interest. When performed along with computerized means, mass prediction of gene products can be effected.

In addition, for identifying new gene products by interspecies sequence comparison, the expressed sequences derived from non-human species can be used for new human splice variants prediction.

More details are provided in U.S. patent application Ser. No. 10/000,000 filed concurrently herewith and assigned to the same assignee hereof. This application contains subject matter related in certain respects, to the subject matter of the present application, the teachings of which applications are incorporated herein by reference.

Example 2

Granulocyte Colony Stimulating Factor (GCSF)

Background

The first line of defense against infectious agents is comprised primarily of polymorphonuclear granulocytes, macrophages, natural killer cells and cytotoxic lymphocytes. GCSF, a central mediator of the endogenous response to infection and inflammation, plays a critical role in the process of hematopoiesis, regulating the proliferation, differentiation and survival of neutrophils and neutrophilic progenitor cells. It is produced mainly by hematopoietic cells, such as monocytes/macrophages and lymphocytes. Other cells, such as fibroblast, endothelial cells, astrocytes and bone marrow stromal cells, can also produce GCSF following activation by LPS, IL-1 or TNF-$\alpha$. Indeed, GCSF production is sharply increased in response to bacterial infection and cell-mediated immune responses, supporting its role in vivo as a host defense against microorganisms. In vitro, GCSF exhibits stimulation of neutrophil production from precursor cells and enhancement of mature neutrophil function as augmentation of their antibody-dependant cellular cytotoxicity (ADCC). The dual action of GCSF in vitro, suggested that it would be useful clinically to stimulate hematopoietic recovery in situations of reduced bone marrow capacity or to enhance the ability to resolve infections in immunocompromised hosts. In its native form, the GCSF protein is O-glycosylated with a molecular mass of approximately 20 kD. It is a member of a family of cytokines that have a four-$\alpha$-helical bundle structure which contribute importantly to its three-dimensional structure. GCSF mediates its biological actions by binding to a specific cell surface receptor, the GCSF-R, which is expressed on neutrophils, their precursors and some leukemic cell lines. Binding of GCSF causes receptor dimerization and activation of signaling cascades such as the Jak-STAT and mitogen-activated kinase pathways. The receptor has no intrinsic tyrosine kinases activity but rather it activates a number of cytoplasmic tyrosine kinases that initiate the cascade of signaling events. There are four tyrosine residues in the cytoplasmic region of the GCSF-R that are rapidly phosphorylated following ligand binding and have been shown to have specific roles in mediating the various activities of GCSF (Basu et al. 2002. International Journal of molecular Medicine. 10:3-10; Layton J. E. 1992. Growth Factors Vol. 6, Pp. 17-186; Young et al. 1997. Protein Science. 6:1228-1236; Layton et al. 1999. The Journal of Biological Chemistry. Vol. 274, No. 25, Pp. 17445-17451; Bishop et al. 2001. The Journal of Biological Chemistry. Vol. 276, No. 36, Pp. 33465-33470; Hubei et al. 2003. Ann Hematol. 82:207-213; Kuga et al. 1989. Biochemical and biophysical research communications. Vol. 159, No. 1. Pp 103-111; Clark-Lewis et al. 1988. The Journal of Immunology. Vol. 141, No. 3, Pp 881-889).

Clinical Application

Neutropenia (low neutrophils in the blood) is still the leading factor limiting the use of chemotherapy for the treatment of neoplastic diseases and a major cause of morbidity and mortality following hematopoietic stem cell transplantation. GCSF is widely employed clinically to treat cancer patients undergoing chemotherapy in order to alleviate the depression of white blood cells levels produced by cytotoxic therapeutic agents. It has been also used to accelerate hematopoietic recovery after transplantation and therefore reduce the risks of serious infection. Use of this cytokine reduces the duration of neutropenia, enhances hematopoietic reconstitution and increases the yield of the progenitor cells. Since GCSF treatment leads to rapid expansion of bone marrow cellularity and the appearance of progenitors in peripheral blood, it has been used to mobilize $CD34^+$ hematopoietic stem cells from the marrow to the blood (peripheral blood stem cells) for use in hematopoietic transplantation. Approved pharmaceutical forms of GCSF for human use include a recombinant nonglycosylated protein expressed in *Escherichia coli* (filgrastim, produced by Amgen, Thousand Oaks, Calif., USA) and a glycosylated form expressed in Chinese hamster ovary cells (lenograstim, produced by Chugai Pharmaceuticals, Tokyo, Japan). Both forms have similar biological activities and bioavailability following subcutaneous or intravenous administration.

GCSF Splice Variants Structure

A brief description is now provided of GCSF splice variants according to the present invention. GCSF splice variant T3 [HUMGCSF_P4 (SEQ ID NO:1); HUMGCSF_T3 (SEQ ID NO:3), FIGS. 1a and b, respectively, shown according to the name of the cluster, HUMGCSF) results from alternative splicing of the GCSF gene, thus causing a retention of intron 2 (according to refsec GenBank Accession No. NM_172220), leading to an insertion of a stop codon and the generation of a truncated protein (FIGS. 2-4; FIG. 2 shows the EST support for the variant T3; FIG. 3 shows the alignment of the variant T3 (with the name HUMGCSF_P4) and the known protein; FIG. 4 shows the known protein [e.g., wild type (WT); CSF3_HUMAN—SEQ ID NO:128] structure as compared to variant T3 according to the present invention). GCSF splice variant T3 encodes a 104 amino acids long protein, which contains amino acids 14-101 of WT GCSF and a unique sequences of six amino acids at the C-terminus of the protein (VSVRKG—SEQ ID NO:2). This splice variant has a novel signal P (signal peptide) and contains part of the IL6/GCSF/MGF family domain (residues 47-97, out of 51-202 of the WT or known protein sequence).

Comparison Report Between HUMGCSF_P4 and CSF3_HUMAN

1. An isolated chimeric polypeptide HUMGCSF_P4 (SEQ ID NO:1), comprising a first amino acid sequence being at least 70%, optionally at least 80%, preferably at least 85%, more preferably at least 90% and most preferably at least 95% homologous to a polypeptide having the sequence MSPEPALSP corresponding to amino acids 1-9 of HUMGCSF_P4 (SEQ ID NO:1), a second amino acid sequence being at least 90% homologous to ALQLLLWHSALWTVQEATPLG-PASSLPQSFLLKCLEQVRKIQGDGAALQEKL corresponding to amino acids 14-65 of CSF3_HUMAN (SEQ ID NO:128), which also corresponds to amino acids 10-61 of HUMGCSF_P4 (SEQ ID NO:1), a third amino acid sequence being at least 90% homologous to CATYKLCHPEELV-LLGHSLGIPWAPLSSCPSQALQL corresponding to amino acids 69-104 of CSF3_HUMAN (SEQ ID NO:128), which also corresponds to amino acids 62-97 of HUMGCSF_P4 (SEQ ID NO:1), and a fourth amino acid sequence being at least 70%, optionally at least 80%, preferably at least 85%, more preferably at least 90% and most preferably at least 95% homologous to a polypeptide having the sequence VSVRKG (SEQ ID NO:2) corresponding to amino acids 98-103 of HUMGCSF_P4 (SEQ ID NO:1), wherein said first amino acid sequence, second amino acid sequence, third amino acid sequence and fourth amino acid sequence are contiguous and in a sequential order.

2. An isolated head of HUMGCSF_P4 (SEQ ID NO:1), comprising a polypeptide being at least 70%, optionally at least about 80%, preferably at least about 85%, more preferably at least about 90% and most preferably at least about 95% homologous to the sequence MSPEPALSP of HUMGCSF_P4 (SEQ ID NO:1).

3. An isolated chimeric polypeptide for an edge portion of HUMGCSF_P4 (SEQ ID NO:1), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LC, having a structure as follows: a sequence starting from any of amino acid numbers 61-x to 61; and ending at any of amino acid numbers 62+((n−2)−x), in which x varies from 0 to n−2.

4. An isolated polypeptide for a tail of HUMGCSF_P4 (SEQ ID NO:1), comprising a polypeptide being at least 70%, optionally at least about 80%, preferably at least about 85%, more preferably at least about 90% and most preferably at least about 95% homologous to the sequence VSVRKG (SEQ ID NO:2) in HUMGCSF_P4 (SEQ ID NO:1).

Therapeutic Potential of GCSF Splice Variant

GCSF is widely employed clinically to treat cancer patients undergoing chemotherapy in order to alleviate the depression of white blood cells levels and to accelerate hematopoietic recovery after transplantation. Furthermore, much interest has focused on the use of GCSF to mobilize $CD34^+$ hematopoietic stem cells from the marrow to the blood for use in hematopoietic transplantation. In addition, human recombinant GCSF (HR-GCSF) can be used to stimulate a sustained elevation of circulating neutrophils in lactating dairy cows which suffer from mastitis (Cullor J S, et al., 1990; Vet. Clin. Pathol. 19: 9-12).

GCSF is currently administered as frequent injections of significant quantities of the cytokine throughout the course of the treatment. In addition, GCSF requires stringent formulation and storage conditions. Much effort was placed in developing alternative or improved molecules that demonstrate cytokine function but have superior pharmacological properties. GCSF splice variants according to the present invention may fulfill these requirements, exhibiting an increased stability while retaining part or all of the biological activity of GCSF.

Thus, the present inventors uncovered a therapeutic agent which can be used to: (i) increase white blood cell counts (e.g., neutrophils, neutrophil progenitor cells) in a subject in need thereof [e.g., a subject undergoing chemotherapy, hematopoietic stem cell transplantation, a subject suffering from mastitis (such as a lactating cow)], and (ii) mobilize CD24+ hematopietic stem cells from the bone marrow to the peripheral blood. Such an agent is a polypeptide homologous to the GCSF variant of the present invention (SEQ ID NO:1), and/or a polynucleotide homologous to SEQ ID NO:3.

It will be appreciated that such an agent can be administered or provided to an individual in need thereof per se or as part of a pharmaceutical composition with a pharmaceutical acceptable carrier (e.g., PEG and liposomes).

Example 3

Tumor Necrosis Factor Receptor-3 (TNR3)/Lymphotoxin-β Receptor (LT-βR)

Background

Lymphotoxin-β receptor (LT-βR) is a member of the tumor necrosis factor receptor (TNFR) superfamily and is expressed on the surface of most of cell types, including cells of epithelial and myeloid lineages but not on T and B lymphocytes. LT-βR can specifically bind two ligands: the membrane form of lymphotoxin, LT-α1/β2, which is uniquely expressed on activated lymphoid cells and LIGHT, a member of the TNF superfamily, which is induced on the cell surface during T cell activation. LT-βR has been speculated to play an essential role in the development of lymphoid organs. Thus, LT-β knock-out mice exhibit impaired lymph node development and loss of splenic architecture. In addition, LT-βR deficient mice were found to lack Peyer's patches, colon-associated lymphoid tissues and all lymph nodes. Moreover, stimulation of LT-βR on certain cell lines by LT-α1/β2 or anti-LTβR antibodies was found to induce cell death, chemokine secretion, and activation of nuclear factor κB (NFκB), suggesting an important biological function for LT-βR in mature individuals.

Like other members of the TNF receptor family, the cytoplasmic domain (CD) of LT-βR does not include consensus sequences characteristic of enzymatic activity. Thus, signaling is thought to be mediated by the proteins interacting with LT-βR such as the two serine/threonine protein kinases, p50 and p80 and the two members of the TNF receptor-associated factor (TRAF) family, TRAF3 and TRAF5, which specifically associate with the LT-βR(CD). Further study has indicated that TRAF3 plays an important role in mediating LT-βR-induced apoptosis, whereas TRAF5 involves in the activation of NFκB. On the other hand, several members of the TNFR superfamily (such as TNFRI, Fas, DR3, DR4, and DR5) contain a common motif, the death domain, in their cytoplasmic region that initiate the activation of caspase cascades to execute apoptosis. LT-βR(CD) does not contain a death domain, but signaling through LT-βR can also induce apoptosis. It was shown that the cytoplasmic domain of TNFRI can self-associate through its death domain, therefore overexpression of TNFRI or of the cytoplasmic domain thereof can induce receptor clustering, a crucial step for subsequent intracellular signaling. Despite the absence of the death domain, the LT-βR(CD) is capable of self-association. Thus, overexpression of LT-βR is sufficient to trigger apoptosis without the need for ligand conjugation (Tamada et al. 2002. The Journal of Clinical Investigation. Vol. 109, No. 4, Pp. 549-557; Shao et al. 2003. Eur. J. Immunol. 33:1736-1743; Ettinger et al. 1996. Proc. Natl. Acad. Sci. USA. Vol. 93, Pp. 13102-13107; Wu et al. 1999. The Journal of Biological Chemistry. Vol. 274, No. 17, Pp. 11868-11873; Hehlgans et al. 2002. Cancer Research 62:4034-4040).

Clinical Application

It has been shown that signaling through LT-βR induced cell death in some human adenocarcinoma tumor lines (HT-29 and WiDr) in the presence of IFN-γ. Combined in vivo treatment of human adenocarcinoma cells (WiDr), which form solid tumors in immunocompromised mice, with an agonistic anti-LT-βR antibody and human IFN-γ resulted in tumor growth arrest. Contrary to these findings, it has been shown that activation of LT-βR on fibrosarcoma tumor cells is necessary for angiogenesis and solid tumor growth. Prevention of LT-α1/β2-LT-βR signaling, by the release of LTβR-Fc from the tumor cells, inhibited tumor angiogenesis and neovascularization, and resulted in tumor growth arrest in mice. In addition, LT-βR activation on the tumor cells induced enhanced release of MIP-2, an angiogenic CXC chemokine. Thus, the interaction of activated LT-α1/β2-carrying lymphocytes with LT-βR-expressing tumor cells can initiate a novel pro-angiogenic pathway, leading to organized tumor tissue development. In addition to its modulation of tumor growth, LT-βR was shown to be involved in immune regulation. In vivo blockade of LIGHT and LTα1/β2 by administration of soluble lymphotoxin β receptor-Ig (LTβR-Ig) inhibited the cytotoxic T lymphocyte (CTL) response to host antigenic disparities and ameliorated lethal graft-versus-host disease (GVHD) in a B6 to BDF1 mouse model. In addition, it has been shown that treatment of rodents with the fusion protein, LT-βR-Ig, prevents the development of autoimmune diseases as insulitis and uveitis.

TNR3-LT-βR Splice Variant Structure

Figure 6:
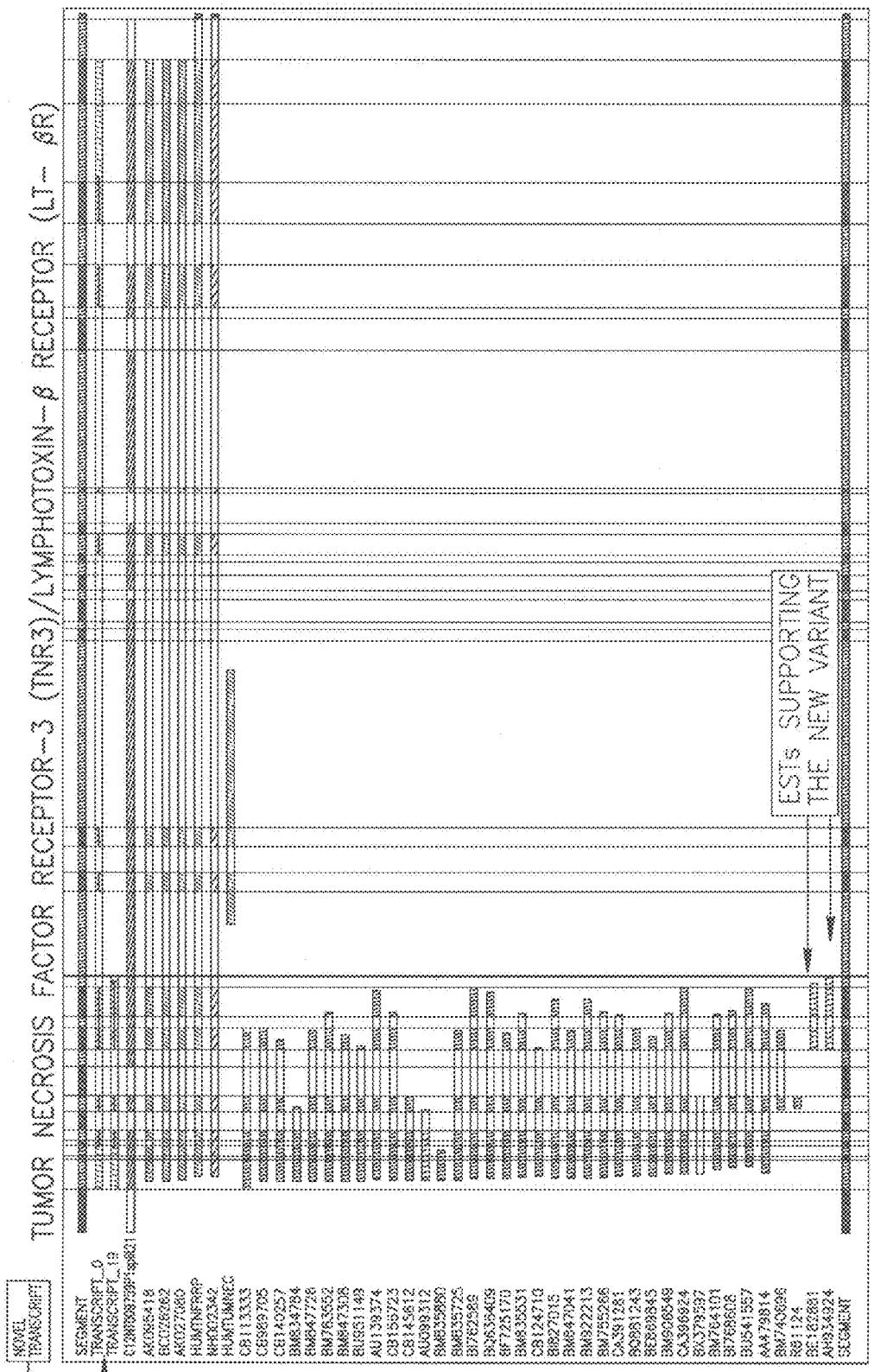
FIG. 6 is a schematic illustration depicting the graphical viewer scheme presenting the new variant of TNR3 (transcript_19) as compared to the wild type mRNA. The ESTs supporting the new variant are indicated. Transcript indicated as "0" represents known mRNA. The pattern code is as in FIG. 2.

A brief description is now provided of TNR3-LT-βR splice variants according to the present invention. TNR3 splice variant transcript_19 (SEQ ID NOs:5 and 7, FIGS. 5a-b; FIG. 5a shows the nucleic acid sequence with the name of the cluster, HUMTNFRRP, with start and stop codons marked in bold and underlined; FIG. 5b shows the corresponding amino acid sequence encoded by this nucleic acid sequence, with the protein name HUMTNFRRP_P14 and with the unique region highlighted) results from alternative splicing of the TNR3 gene, thus causing the extension of exon 4, leading to an insertion of a stop codon and the generation of a truncated protein [FIGS. 6-8; FIG. 6 shows EST support for the variant; FIG. 7 shows the alignment of the variant protein HUMTN-FRRP_P14 with a portion of the known protein, TNR3_HUMAN; FIG. 8 compares the structure of the WT or known TNFR3 protein to the variant protein (shown with the name T19)]. This TNR3 splice variant encodes a 166 amino acids long protein which contains the N-terminal signal sequence (residues 1-30), three TNFR CYS repeats (out of four of the WT or known protein) and a unique sequence of 9 amino acids at the C-terminus of the protein (SEQ ID NO:6). It is predicated to be a secreted protein due to the fact that it lacks the transmembrane domain of the WT or known protein.

Comparison Report Between HUMTNFRRP_P14 (SEQ ID NO:5) and TNR3_HUMAN (SEQ ID NO:129)

1. An isolated chimeric polypeptide HUMTNFRRP_P14 (SEQ ID NO:5), comprising a first amino acid sequence being at least 90% homologous to MLLPWATSAPGLAWGPLV-LGLFGLLAASQPQAVPPYASENQTCRDQEKEYY EPQHRICCSRCPPGTYVSAKCSRIRDTV-CATCAENSYNEHWNYLTICQLCRPC DPVMGLEE-IAPCTSKRKTQCRCQPGMFCAAWA-LECTHCELLSDCPPGTEAEL K corresponding to amino acids 1-157 of TNR3_HUMAN (SEQ ID NO:129), which also corresponds to amino acids 1-157 of HUMTNFR- RP_P14 (SEQ ID NO:5), and a second amino acid sequence being at least 70%, optionally at least 80%, preferably at least 85%, more preferably at least 90% and most preferably at least 95% homologous to a polypeptide having the sequence GQRSLRGWM (SEQ ID NO:6) corresponding to amino acids 158-166 of HUMTNFRRP_P14 (SEQ ID NO:5), wherein said first amino acid sequence and second amino acid sequence are contiguous and in a sequential order.

2. An isolated polypeptide for a tail of HUMTNFRRP_P14 (SEQ ID NO:5), comprising a polypeptide being at least 70%, optionally at least about 80%, preferably at least about 85%, more preferably at least about 90% and most preferably at least about 95% homologous to the sequence GQRSL-RGWM (SEQ ID NO:6) in HUMTNFRRP_P14 (SEQ ID NO:5).

The Therapeutic Potential of TNR3-LT-βR Splice Variant

TNR3 splice variant T19 encodes a soluble receptor which contains three TNFR CYS repeats (out of four of the WT or known protein). It can inhibit TNR3 signaling by competing on the ligand with the membrane-bound receptor, thus preventing LT-α1/β2 from binding to the cell surface receptor and activating it. A soluble form of TNR3 was shown already to bind LT-α1/β2 in vitro. Blocking LTαβ/TNR3 interactions was shown in vivo by administration of TNR3-Fc fusion protein or by the creation of mice which constitutively express a soluble murine TNR3-human IgG1 (Fc) transgene. Blocking TNR3 signaling could have important therapeutic potential for the treatment of cancer, graft-vs-host disease and autoimmune diseases, such as rheumatoid arthritis, Crohn's disease, insulitis and uveitis.

Thus, the present inventors uncovered a therapeutic agent which can be used to: (i) inhibit or prevent the binding of LT-α1/β2 to its TNR3 receptor in vivo or ex vivo, (ii) prevent tumor growth (e.g., solid tumor, such as fibrisarcoma) by preventing the activation of LT-βR, (iii) prevent and/or treat graft-versus-host disease (GVHD) by inhibition of the cytotoxic T lymphocyte (CTL) response, (iv) prevent and/or treat autoimmune diseases (e.g., insulitis, uveitis). Such an agent is a polypeptide homologous to the TNR3 splice variant T19 of the present invention (SEQ ID NO:5) and/or a polynucleotide homologous to SEQ ID NO:7.

It will be appreciated that such an agent can be administered or provided to an individual in need thereof per se or as part of a pharmaceutical composition with a pharmaceutical acceptable carrier (e.g., PEG and liposomes).

Example 4

Interleukin-4 Receptor (IL-4R)

Background

IL-4 is a pleiotropic and multifunctional cytokine produced by activated T cells, mast cells and basophils. IL-4 plays a critical role in regulating the outcome of an immune response by facilitating Th2 cell differentiation and suppressing the differentiation of IFN-γ-producing CD4+ T cells, thereby favoring humoral immune responses. The other important function of IL-4 is the regulation of immunoglobulin class-switching. It induces class-switching to IgE and IgG4 in human B cells, suggesting a preeminent role of IL-4 in the regulation of allergic conditions. IL-4 also exerts a wide variety of other effects on hematopoietic and nonhematopoietic cells. It enhances the expression of CD23 and class II MHC molecules in B cells and upregulates surface expression of the receptor complex for IL-4. On vascular endothelial cells, IL-4 together with TNF induces the expression of VCAM-1 (vascular cell adhesion molecule 1) and downregulates the expression of E-selectin, thereby changing the adhesive characteristics of endothelial cells and facilitating tissue infiltration by allergic inflammatory cells, such as eosinophils.

IL-4 receptors (IL-4R) are expressed on hematopoietic cells and a range of nonhematopoietic cells including epithelial, endothelial, muscle, fibroblast and liver cells. On hematopoietic cells, the receptor complex for IL-4 is composed of a 140 kDa high-affinity ligand-binding chain, the IL-4-receptor α chain (IL-4Rα) and the so-called common γ chain (γC) that is shared between IL-2, IL-7, IL-9 and IL-15. In contrast, in non-hematopoietic cells, the predominant accessory chain of the IL-4 receptor complex is IL-13Rα1. Furthermore, the receptor complex for IL-13 consists of various combinations of the IL-4Rα, IL-13Rα1 and IL-13Rα2. This may explain the redundancy in biological responses mediated by IL-4 and IL-13. Both IL-4 and IL-13 have been implicated in allergic diseases, probably through redundant and independent pathways. Although homodimerized IL-4Rα can generate biological signals within the cell, physiologic signaling requires heterodimerization of IL-4Rα and the accessory chain (γC). Neither IL-4Rα nor γC contains intrinsic kinase activities; rather the IL-4R requires receptor-associated kinases for the initiation of signal transduction.

Three members of the Janus kinase (Jak) family-Jak-1, Jak-2 and Jak-3 have been shown to be activated in response to IL-4R engagement and to associate with the components of the receptor complex for IL-4. Jak-1 has been proposed to bind IL-4Rα whereas Jak-3 associates with the γC chain. IL-4-IL-4R engagement results in tyrosine phosphorylation of Jak-1 and Jak-3, leading to tyrosine phosphorylation of IL-4Rα itself, a process occurring immediately after IL-4R engagement. Five conserved tyrosine residues (Tyr497, Tyr575, Tyr603, Tyr631 and Tyr713) that can be potentially phosphorylated are present in the cytoplasmic domain of IL-4Rα. Following tyrosine phosphorylation, these conserved tyrosine residues become potential docking sites for downstream signaling molecules containing Src-homology-domain 2 (SH2) or phosphotyrosine-binding domains (Mueller et al. 2002. Biochimica et Biophysica Acta. 1592:237-250; Nelms et al. 1999. Annu. Rev. Immunol. 17:701-738; Pan et al. 1999. Current Opinion in Immunology. 11:615-620; Gessner et al. 1999/2000. Immunobiology. 201, 285-307).

IL-4R Splice Variants-Structure

The present inventors uncovered a novel IL-4R isoform by applying the LEADS clustering and assembly algorithm and the annotation process, as described above.

Figure 11:
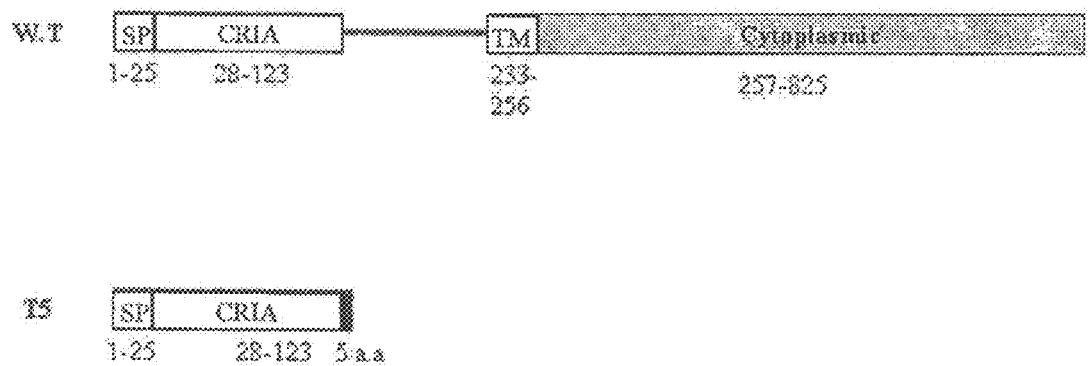
FIG. 11 is a schematic illustration showing the protein domain structure of wild-type IL4R protein (SwissProt accession: IL4R_Human; GenBank Accession No. P24394; SEQ ID NO:130) and the variant of the present invention (SEQ ID NO:9). Unique regions are indicated by U and arrow (SEQ ID NO:10).
Figure 13:
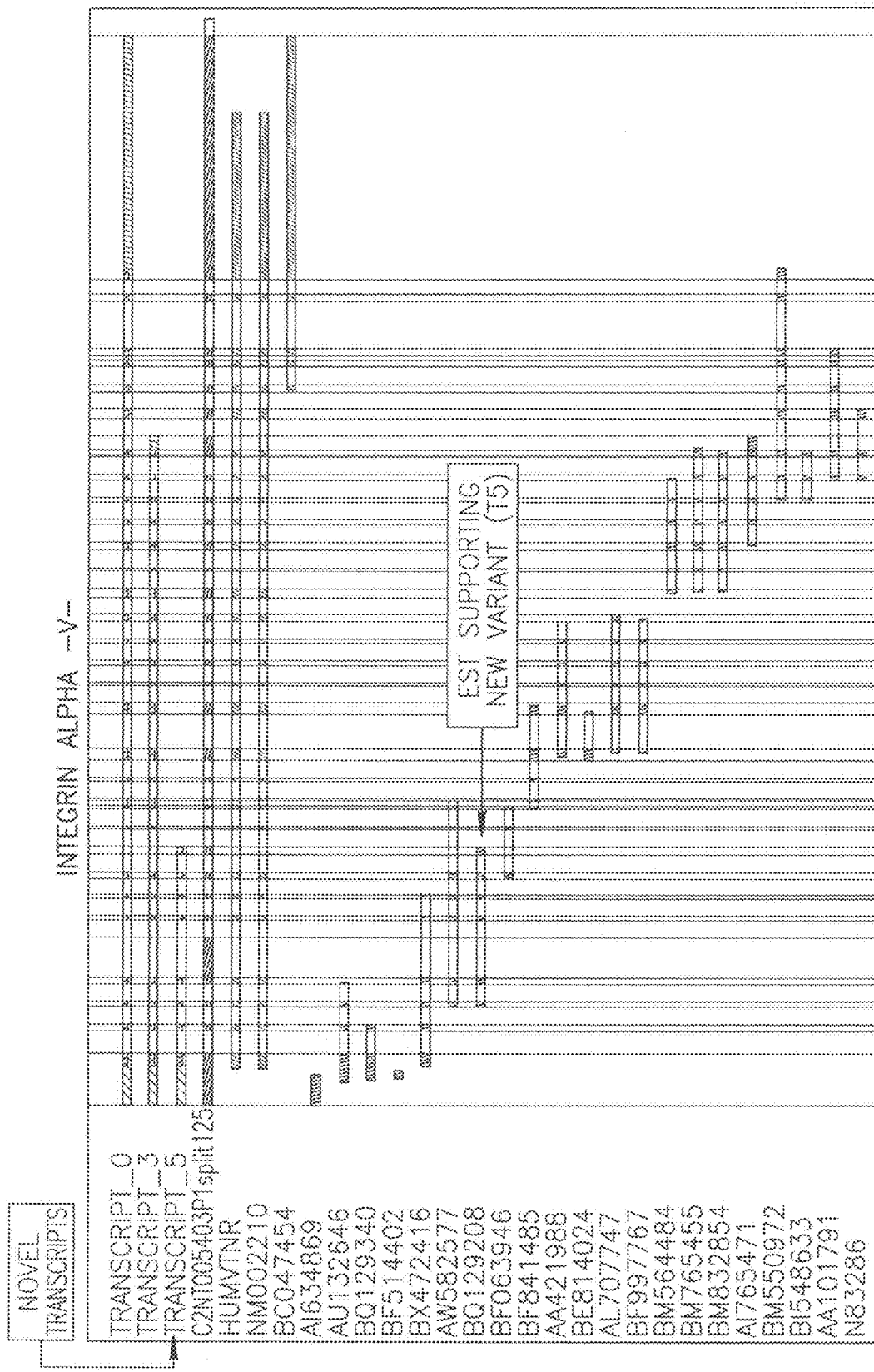
FIG. 13 is a schematic illustration depicting the graphical viewer scheme presenting the new variant of integrin α5 ITAV (Transcript_5) as compared to the wild type mRNA. The ESTs supporting the new variant are indicated. Transcript indicated as "0" represents known mRNA. The pattern code is as in FIG. 2.
Figure 17:
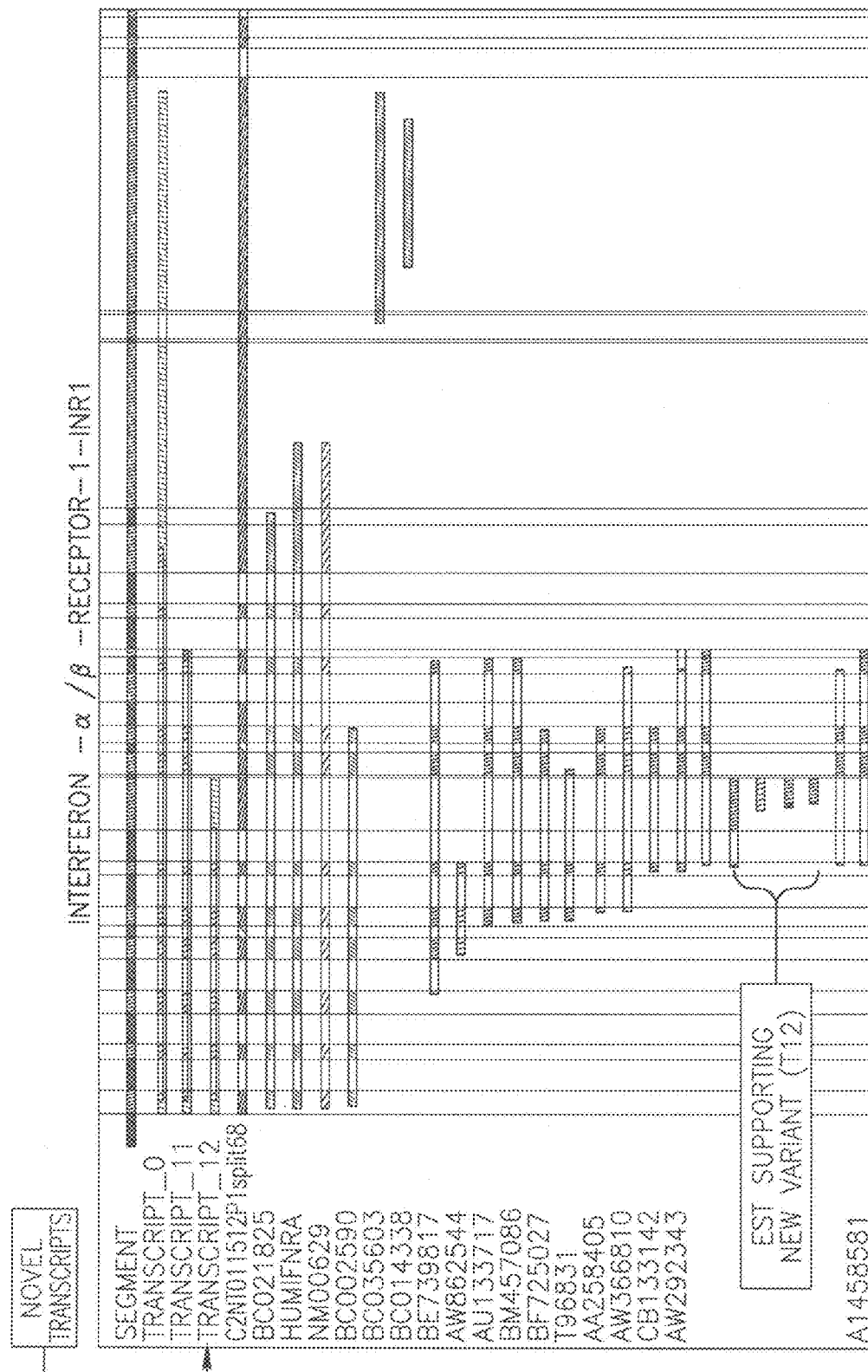
FIG. 17 is a schematic illustration depicting the viewer scheme presenting the new variant of INR1 (Transcript_12) as compared to the wild type mRNA. The ESTs supporting the new variant are indicated. Transcript indicated as "0" represents known mRNA. The pattern code is as in FIG. 2.

IL-4R splice variant T5 (amino acid sequence—SEQ ID NO:9, nucleic acid sequence—SEQ ID NO:11, FIGS. 9a-b) results from an alternative splicing of the IL-4R gene, thus introducing a new exon, named 4a', between exons 4 and 5, leading to an insertion of a stop codon and the generation of a truncated protein (FIGS. 10-11). IL-4R splice variant T5 encodes a 126 amino acids long protein which contains the N-terminal signal sequence (residues 1-25), the complete CRIA domain and a unique sequence of 5 amino acids at the C-terminus of the protein (SEQ ID NO:10). Since the new IL-4R variant lacks the transmembrane domain, it is predicated to be a secreted protein.

Therapeutic Applications for the IL-4R Splice Variants of the Present Invention

Since IL-4Rα is an independent high affinity IL-4 binding subunit, the new secreted form of IL-4Rα (splice variant T5; SEQ ID NO:9), can serve as a powerful antagonist of the IL-4/IL-4R interaction since it contains the complete CRIA domain of IL-4Rα it can compete with the membrane-bound receptor on the ligand and prevent the activation of the membrane-bound IL-4R receptor. Indeed, in a murine model of allo-transplantation, the recombinant extracellular domain of IL-4R was found to block IL-4 functions both in vitro and in vivo.

IL-4-IL4R signaling pathways play a major role in the pathogenesis of allergic diseases. Moreover, naturally occurring mutations of the IL-4Rα chain have been identified and implicated in a genetic predisposition for atopic asthma. Blocking of IL-4 signaling could therefore have an important therapeutic potential for the treatment of asthma and other allergic disorders. In addition to its role in allergic disorders, IL-4R signaling was shown to be involved in autoimmune diseases and in organ transplantation. Recently, it has been shown that IL-4 may serve multiples roles in the development of lupus. Evidence for a novel role for IL-4 in the development of lupus nephritis comes from recent studies, which suggest that IL-4 may directly promote extracellular matrix deposition in the glomeruli. Blockage of IL-4 signaling may ameliorates glomerulosclerosis and prevents the development of end-stage renal disease and in general might have a therapeutic potential in the treatment of lupus, organ transplant rejection and graft-vs-host diseases.

Thus, the present inventors uncovered a therapeutic agent which can be used to: (i) prevent the association between IL4 and IL4R, (ii) treat a disorder associated with IL-4-IL-4R signaling such as asthma (e.g., atopic asthma), allergic disorder, autoimmune diseases (e.g., lupus nephritis), organ transplantation rejection, graft-vs-host disease by preventing the association between IL-4 and IL-4R. Such an agent is a polypeptide homologous to the IL-4Rα splice variant of the present invention (SEQ ID NO:9), and/or a polynucleotide homologous to SEQ ID NO:11.

It will be appreciated that such an agent can be administered or provided to an individual in need thereof per se or as part of a pharmaceutical composition with a pharmaceutical acceptable carrier (e.g., PEG and liposomes).

Example 5

Integrin Alpha-V

Background

The integrin family is composed of 15 α and 8 β subunits that form over twenty different αβ heterodimeric combinations on cell surfaces. Integrins recognize extracellular matrix (ECM) proteins and cell surface immunoglobulin family molecules through short peptide sequences. Several integrins (e.g., αvβ3, α5β1, αIIbβ3) strongly interact with the tripeptide Arg-Gly-Asp (RGD) sequence within the context of specific ECM or cell surface proteins. While some integrins recognize only a single ECM protein ligand (e.g. α5β1 recognizes only fibronectin), others can bind to several ligands (e.g., αvβ3 binds vitronectin, fibronectin, osteopontin, fibrinogen, denatured or proteolysed collagen and other matrix proteins). The integrin-mediated adhesion of cells to the ECM leads to bi-directional intracellular signaling events that can regulate cell survival, proliferation and migration. In contrast, inhibition of integrin-ligands interactions suppresses cellular growth or induces apoptotic cell death.

Integrin αvβ3, the most promiscuous member of the integrin family, exhibits no expression on normal tissues such as epithelial cells and very low levels on resting vascular, uterine smooth muscle, endothelium, certain activated leukocytes, macrophages and osteoclasts. On the other hand, it is expressed on tumor cells including late-stage glioblastomas, ovarian carcinoma and melanomas. Thus, integrin αvβ3 was found to contribute to the progression of melanoma by regulating melanoma cell proliferation, survival and metastases. On endothelium cells, integrin αvβ3 involves in the angiogenic process in several ways. It regulates cell adhesion to the matrix, transmit signals to the cell nucleus and is exhibits a pro-angiogenic effect by co-operating with VEGFR-2 receptor through the activation of cell signaling and the regulation of cell cycle gene expression.

Several integrin β subunits are involved in angiogenesis processes. For example, the β3 and β5 chains which associate with the αv chain. These subunits share 53% homology, however their ligand specificities are different. While αvβ3 prefers the binding to osteopontin, the αvβ5 prefers the binding to vitronectin. In fact, two different cytokine-dependent pathways participate in the activation of these integrins. While the αvβ3 pathway involves basic FGF (FGF-2) or TNF-α, αvβ5 uses VEGF, TGF-α, or PMA. Since the integrin αv subunit is widely expressed on most cell types and associates with several different β subunits, the expression of αvβ3 is likely to be regulated by the transcription of the β subunit. Other angiogenesis related αv integrin complexes include the αvβ1 which is associated with brain blood vessels and cell migration in squamous cell carcinoma; αvβ8, identified on tumor cells; and αvβ6 which induces secretion of MMP-2 in colon cancer and is important in colon cancer progression (Kerr et al. 2000. Exp. Opin. Invest. Drugs 9(6): 1271-1279; Tucker G. C. 2003. Current Opinion in Investigational Drugs. 4(6): 722-731; Mould et al. 2000. The Journal of Biological Chemistry. Vol. 275, No. 27, Pp. 20324-20336).

Clinical Applications

Integrins were found to be involved in pathological processes of both acute and chronic diseases such as ocular disease, cancer (primary tumors and metastasis), cardiovascular (stroke and heart failure) and inflammatory conditions (rheumatoid arthritis). Evidence clearly demonstrates that the αv integrin is associated with multiple tumor cells, including human breast, renal, cervical, colon, prostate, bladder, lung and melanoma. Antibodies to αv prevent human melanoma tumor formation in nude mice and antagonists of αvβ3 potentially inhibit angiogenesis in a number of animal models. Thus, blocking the αv integrin serves as an important therapeutic strategy in cancer therapy. Inhibitors of integrin function such as monoclonal antibody and peptide antagonist, which mimics the RGD ligand recognition domain common to αv integrin ligands, are now in phase II clinical trials.

ITAV-Splice Variant T5 Structure

The present inventors uncovered a novel isoform of integrin αV (ITAV; HUMVTNR_P5—SEQ ID NO:13, HUMVT-NR_T5 (SEQ ID NO:15)—SEQ ID NO:15, FIGS. 12*a-b*) by applying LEADS clustering and assembly algorithm and the annotation process, as described above.

The ITAV splice variant T5 results from alternative splicing of the ITAV gene thereby introducing a novel exon, named exon 7a, between exons 7 and 8, leading to the insertion of a stop codon and the generation of a truncated ITAV protein (FIGS. 12-15). ITAV splice variant T5 encodes a 298 amino acids long protein which contains the N-terminal signal sequence (residues 1-30), part of the extracellular domain of WT ITAV (SEQ ID NO:131) and a unique sequence of 45 amino acids at the C-terminus of the protein (ENTEALRR-KITCPKSLACNLLFRDSNGDSLTPEVFFMMLNKSFGL SEQ ID NO:14). Since the ITAV splice variant of the present invention (SEQ ID NO:13) does not include the transmembrane domain present in the WT protein (amino acids 993-1016 of the WT protein, SEQ ID NO:131), it is predicated to be a secreted protein.

Comparison Report Between HUMVTNR_P5 (SEQ ID NO:13) and ITAV_HUMAN (SEQ ID NO:131)

1. An isolated chimeric polypeptide HUMVTNR_P5 (SEQ ID NO:13), comprising a first amino acid sequence being at least 90% homologous to MAFPPRRRLRLGPRGLPLLLS-GLLLPLCRAFNLDVDSPAEYSGPEGSYFGFAV DPPVP-SASSRMFLLVGAPKANTTQPGIVEGGQV-LKCDWSSTRRCQPIEFDATG NRDYAKDDPLEFKSHQWFGASVRSKQD-KILACAPLYHWRTEMKQEREPVGT CFLQDGTK-TVEYAPCRSQDIDADGQGFCQGGFSID-FTKADRVLLGGPGSFYW QGQLISDQVAEIVSKYDPNVYSIKYN-NQLATRTAQAIFDDSYLG corresponding to amino acids 1-253 of ITAV_HUMAN (SEQ ID NO:131), which also corresponds to amino acids 1-253 of HUMVTNR_P5 (SEQ ID NO:13), and a second amino acid sequence being at least 70%, optionally at least 80%, preferably at least 85%, more preferably at least 90% and most preferably at least 95% homologous to a polypeptide having the sequence ENTEAL-RRKITCPKSLACNLLFRDSNGDSLTPE-VFFMMLNKSFGL (SEQ ID NO:14) corresponding to amino acids 254-298 of HUMVTNR_P5 (SEQ ID NO:13), wherein said first amino acid sequence and second amino acid sequence are contiguous and in a sequential order.

2. An isolated polypeptide for a tail of HUMVTNR_P5, comprising a polypeptide being at least 70%, optionally at least about 80%, preferably at least about 85%, more preferably at least about 90% and most preferably at least about 95% homologous to the sequence ENTEALRRKITCPK-SLACNLLFRDSNGDSLTPEVFFMMLNKSFGL (SEQ ID NO:14) in HUMVTNR_P5 (SEQ ID NO:13).

Therapeutic Applications for the ITAV Splice Variant of the Present Invention

ITAV splice variant T3 could serve as a powerful antagonist of a variety of integrin interactions. It contains most of the extracellular region of ITAV and therefore is likely to bind the integrin αv ligands. This splice variant can inhibit the integrin signaling by competing with the membrane-bound receptor for the different ligands, thus preventing their binding to the cell surface receptor and as a consequence blocking integrin activation and signaling pathway. Alternatively, it can compete with the WT membrane ITAV for binding of the β subunit, thus preventing the heterodimerization of αv with the β subunit and the subsequent signaling.

Because of the overwhelming evidence favoring the role of αv integrin in the pathogenesis of a wide array of diseases as cancer, cardiovascular and inflammation, inhibitors of this molecule, such as ITAV splice variant T5 (SEQ ID NO:13), may have an important therapeutic potential. ITAV splice variant can play a crucial role in the treatment of the following pathological conditions: cancer (in general, but in particular colon and melanoma); cardiovascular diseases, such as atherosclerosis, restenosis, ischemia and reperfusion injury; immunological related diseases such as immunodeficiency, allergies, asthma, psoriasis, RA and inflammatory bowl diseases/chrone's disease; metabolism related diseases, such as diabetes and diabetes related retinopathy; osteoporosis, sepsis and wound healing.

Thus, the present inventors uncovered a therapeutic agent which can be used to: (i) prevent the binding of endogenous integrin αv with an integrin αv ligand (e.g., ECM proteins or cell surface proteins via e.g., the RGD sequence), (ii) prevent the binding of endogenous integrin αv with a β subunit (e.g., β1, β3, β5, β6, and β8) and thus prevent integrin αv-mediated cell signaling, (iii) treat a disorder associated with integrin αv-mediated cell signaling such as cancer (e.g., colon cancer and melanoma), cardiovascular diseases (e.g., atherosclerosis, restenosis, ischemia and reperfusion injury), immunological related diseases (e.g., immunodeficiency, allergies, asthma, psoriasis, rheumatoid arthritis (RA), inflammatory bowl diseases, Crohn's disease, metabolism related diseases (e.g., diabetes and diabetes related retinopathy), osteoporosis, sepsis and wound healing by preventing the binding of the endogenous αv integrin with at least one αv ligand (e.g., ECM proteins or cell surface proteins via e.g., the RGD sequence) and/or β subunit (e.g., β1, β3, β5, β6, and β8). Such an agent is a polypeptide homologous to the integrin αv (ITAV) variant of the present invention (SEQ ID NO:13), and/or a polynucleotide homologous to SEQ ID NO: 15, and/or the unique peptide derived from the ITAV variant of the present invention (SEQ ID NO:14).

It will be appreciated that such an agent can be administered or provided to an individual in need thereof per se or as part of a pharmaceutical composition with a pharmaceutical acceptable carrier (e.g., PEG and liposomes).

Example 6

Interferon-α/β-Receptor-1-INR1

Background

Type I interferons (IFNs), initially identified for their ability to protect cells from viral infections, are truly pleiotropic cytokines. IFNs are implicated in both normal and neoplastic cell growth regulation and in modulating both innate and adaptive immune responses to microbial challenge. All type I IFNs, IFN-αs, IFN-β, IFN-ω, IFN-κ, and IFN-τ, are functionally active as monomers and activate a specific receptor complex composed of two major subunits, IFNAR-1/INR1 and IFNAR-2/INR2. The high affinity interaction between IFN-α/β and its specific cell surface receptor leads to receptor aggregation and the activation of receptor-associated cytoplasmic tyrosine kinases of the Jak family-Jak1 and Tyk2. These in turn phosphorylate intracellular tyrosine residues of the IFNAR-1 and IFNAR-2 chains, that serve as recruitment sites for the signal transducers and activators of transcription (STAT) proteins, Stat 1-5. Once associated with the activated receptor, the STAT become phosphorylated and form both homodimers and heterodimers, which translocate to the nucleus and bind specific DNA sequences within the promoter regions of IFN-sensitive genes (ISG). The Jak-Stat pathway is an essential signaling pathway for the transcription of many ISGs, whose protein products mediate specific IFN-dependent biologic responses. IFNs mediate a critical role in innate cellular defense against viral infection. Mice deficient in IFN-β or in IFNAR-1 are highly susceptible to viral infections. The antiviral activity of INFs include inhibition of viral replication and protein synthesis and the induction of viral mRNA degradation. In addition to their antiviral activity, IFNs exhibit growth inhibitory activity, either by mediating cell death (through caspases) or by modulating the expression of proteins regulating cell cycle entry and exit, hence mediating growth arrest. IFNs are also involved in the regulation of immune response towards viral or tumor challenge; A well-characterized function of IFNs is their ability to upregulate MHC class I expression and consequently promote CD8+ T cell responses. Moreover, IFNs can regulate the expression of key cytokines that influence T cell responses, namely, IL-12, IL-15 and IFN-γ and of CC-chemokines. IFNs-α/β regulate the functions of immune cells from different lineages including NK cells, dentritic cells and B/T lymphocytes (Deonarain et al. 2002. Current Pharmaceutical Design. Vol. 8, No. 24, Pp. 2131-2137; Brierley et al. 2002. Journal of Interferon and Cytokine Research. 22:835-845).

Clinical Application

Due to their growth inhibitory activity and the modulation of immune responses, type I interferons have been used as therapeutic polynucleotide or polypeptide sequences against a variety of solid tumors and hematological malignancies. IFN-α has been approved for the treatment of chronic myelogenous leukemia (CML), multiple myeloma, hairy cell leukemia and several lymphomas. Thus, IFN-α is the treatment of choice for CML patients which are not eligible for allogeneic bone marrow transplantation. In addition, the therapeutic efficacy of IFNs polynucleotide or polypeptide sequences in the treatment of viral infections and autoimmune diseases has been proved. Thus, IFN-α is the treatment of choice for hepatitis B and C infections and accumulating evidence supports the use of IFN-β for the treatment of multiple sclerosis.

However, although the activity and specificity of function make the IFNs potentially powerful therapeutic agents, they are not the ideal drugs, mainly due to their low stability in vivo.

Thus, there is an intense interest and effort to develop alternative or improved molecules demonstrating IFNs function with superior pharmacological properties. For example, PEGylation of type I IFNs extends the serum half-life and duration of therapeutic activity. PEGylation of IFN-α and IFN-β increased their serum half-life by 6 and 5 fold, respectively, however the PEGylated form of IFN-β exhibited less efficient systemic distribution with some evidence of induction of neutralizing antibodies. In addition, as opposed to their well-characterized function as competitive inhibitors (antagonists), soluble receptors have been shown to exhibit agonistic properties. These include increasing the molecular internal stability of the ligand, protection from proteolysis and modification of the pharmacokinetic properties of the ligand, namely, increasing the in vivo half-life of the ligand while decreasing its clearance. Thus, a soluble form of an IFN receptor should increase the in vivo stability of the ligand (i.e., IFN) and its agonistic properties.

INR1-Splice Variant Structure

The present inventors uncovered a novel isoform of interferon α/β receptor 1 (INR1) named INR1 splice variant T12 [T07758_P6—SEQ ID NO:17 (FIG. 16B); T07758_T12—SEQ ID NO:19 (FIG. 16a)]. INR1 splice variant T12 results from alternative splicing of the INR1 gene, thus introducing a novel exon, named exon 6a, between exons 6 and 7, leading to an insertion of a stop codon and the generation of a truncated protein. INR1 splice variant T12 (SEQ ID NO:19) encodes a 269 amino acids long protein (SEQ ID NO:17) containing the N-terminal signal sequence (residues 1-27), part of the extracellular portion of the WT INR1 (INR1_HUMAN SEQ ID NO:132), including the first two fibronectin type III-like domains and part of the third domain and a unique sequence of 7 amino acids (LYFRRPR—SEQ ID NO:18) at the C-terminus of the protein. Since the INR1 variant T12 (SEQ ID NO:17) does not include the transmembrane domain (which corresponds to residues 437-457 of WT INR1 SEQ ID NO:132), it is predicated to be a secreted protein.

Comparison Report Between T07758_P6 (SEQ ID NO:17) and INR1_HUMAN_V1 (SEQ ID NO:658)

1. An isolated chimeric polypeptide T07758_P6 (SEQ ID NO:17), comprising a first amino acid sequence being at least 90% homologous to MVVLLGATTLVLVAVAPWVLSAAAGGKNLKSPQKVEVDIIDDNFILRWNRS DESVGNVTFSFDYQKTGMDNWIKLSGCQNITSTKCNFSSLKLNVYEEIKLRIR AEKENTSSWYEVDSFTPFRKAQIGPPEVHLEAEDKAIVIHISPGTKDSVMWAL DGLSFTYSLVIWKNSSGVEERIENIYSRHKIYKLSPETTYCLKVKAALLTSWKI GVYSPVHCIKTTVENELPPPENIEVSVQNQNYVLKWDYTYANMTFQVQWLH corresponding to amino acids 2-263 of INR1_HUMAN_V1, which also corresponds to amino acids 1-262 of T07758_P6 (SEQ ID NO:17), and a second amino acid sequence being at least 70%, optionally at least 80%, preferably at least 85%, more preferably at least 90% and most preferably at least 95% homologous to a polypeptide having the sequence LYFRRPR (SEQ ID NO:18) corresponding to amino acids 263-269 of T07758_P6 (SEQ ID NO:17), wherein said first amino acid sequence and second amino acid sequence are contiguous and in a sequential order.

2. An isolated polypeptide for a tail of T07758_P6 (SEQ ID NO:17), comprising a polypeptide being at least 70%, optionally at least about 80%, preferably at least about 85%, more preferably at least about 90% and most preferably at least about 95% homologous to the sequence LYFRRPR (SEQ ID NO:18) in T07758_P6 (SEQ ID NO:17).

Comparison Report Between T07758_P6 (SEQ ID NO:17) and INR1_HUMAN (SEQ ID NO:132)

1. An isolated chimeric polypeptide T07758_P6 (SEQ ID NO:17), comprising a first amino acid sequence being at least 90% homologous to MVVLLGATTLVLVAV corresponding to amino acids 2-16 of INR1_HUMAN (SEQ ID NO:132), which also corresponds to amino acids 1-15 of T07758_P6 (SEQ ID NO:17), a bridging amino acid A corresponding to amino acid 16 of T07758_P6 (SEQ ID NO:17), a second amino acid sequence being at least 90% homologous to PWVLSAAAGGKNLKSPQKVEVDIIDDNFILRWNRSDESVONVTFSFDYQKTG MDNWIKLSGCQNITSTKCNFSSLKLNVYEEIKLRIRAEKENTSSWYEVDSFTPF RKAQIGPPEVHLEAEDKAIVIHISPGTKDSVMWALDGLSFTYSL corresponding to amino acids 18-167 of INR1_HUMAN (SEQ ID NO:132), which also corresponds to amino acids 17-166 of T07758_P6 (SEQ ID NO:17), a bridging amino acid V corresponding to amino acid 167 of T07758_P6 (SEQ ID NO:17), a third amino acid sequence being at least 90% homologous to IWKNSSGVEERIENIYSRHKIYKLSPETTYCLKVKAALLTSWKIGVYSPVHCIK TTVENELPPPENIEVSVQNQNYVLKWDYTYANMTFQVQWLH corresponding to amino acids 169-263 of INR1_HUMAN (SEQ ID NO:132), which also corresponds to amino acids 168-262 of T07758_P6 (SEQ ID NO:17), and a fourth amino acid sequence being at least 70%, optionally at least 80%, preferably at least 85%, more preferably at least 90% and most preferably at least 95% homologous to a polypeptide having the sequence LYFRRPR (SEQ ID NO:18) corresponding to amino acids 263-269 of T07758_P6 (SEQ ID NO:17), wherein said first amino acid sequence, bridging amino acid, second amino acid sequence, bridging amino acid, third amino acid sequence and fourth amino acid sequence are contiguous and in a sequential order.

2. An isolated polypeptide for a tail of T07758_P6 (SEQ ID NO:17), comprising a polypeptide being at least 70%, optionally at least about 80%, preferably at least about 85%, more preferably at least about 90% and most preferably at least about 95% homologous to the sequence LYFRRPR (SEQ ID NO:18) in T07758_P6 (SEQ ID NO:17).

Therapeutic Applications for the INR1 Splice Variant T12 of the Present Invention The INR1 splice variant T12 of the present invention encodes a soluble receptor and can serve as an agonist of the INR1 by increasing the half-life of IFNs in vivo and enhancing their biological effect. Thus, the INR1 splice variant T12 (SEQ ID NO:17) may have an important therapeutic potential for the treatment of the following pathological conditions: cancer, such as solid tumors (e.g., glioblastoma, renal cell carcinoma, melanoma) and hematological malignancies (e.g., chronic myelogenous leukemia (CML), multiple myeloma, non-Hodgkin's lymphoma and hairy cell leukemia), viral infections (e.g., hepatitis B/C, herpes and human papilloma virus) and autoimmune diseases such as multiple sclerosis.

Thus, the present inventors uncovered a therapeutic agent which can be used to: (i) increase the in vivo stability of INF (e.g., IFN-α, IFN-β, IFN-ω, IFN-κ, and IFN-τ), (ii) increase INR1-mediated signaling by stabilizing the interaction between INF (e.g., IFN-α, IFN-β, IFN-ω, IFN-κ, and IFN-τ) and INR1, (iii) treat a disorder associated with INR1 signaling such as cancer [e.g., solid tumors (glioblastoma, renal cell carcinoma, melanoma) or hematological malignancies (chronic myelogenous leukemia (CML), multiple myeloma, non-Hodgkin's lymphoma and hairy cell leukemia)], viral infections (e.g., hepatitis B, hepatitis C, herpes and human papilloma virus) and autoimmune diseases such as multiple sclerosis, by stabilizing the INF (e.g., IFN-α, IFN-β, IFN-ω, IFN-κ, and IFN-τ) or the INF-INR1 interaction. Such an agent is a polypeptide homologous to the interferon a/13 receptor 1 (INR1) variant T12 of the present invention (SEQ ID NO:17), and/or a polynucleotide homologous to SEQ ID NO:19.

It will be appreciated that such an agent can be administered or provided to an individual in need thereof per se or as part of a pharmaceutical composition with a pharmaceutical acceptable carrier (e.g., PEG and liposomes).

Example 7

Overexpression of a Troponin Variant in Cancer

Background

The regulatory protein troponin (Tn) located on actin filament consists of three subunits: TnT, which binds troponin to tropomyosin, TnC, which binds divalent calcium ions, and TnI, which affects myosin-actin interactions. Tn subunits display several molecular and calcium binding variations. During ontogenetic development of cardiac and skeletal muscles the synthesis of multiple isoforms of Tn subunits was detected. Expression of Tn isoforms and the extent of phosphorylation of both TnT and TnI via protein kinase C or protein kinase A under different pathological situations (e.g. ischemia, congenital heart disease, heart failure) can affect the $Ca^{2+}$-stimulated contraction function and the myofibrillar ATPase activity of the heart [Adamcova (1999) Physiol. Res. 48:235-2471. Troponin is commonly used as a marker for predicting cancer-therapy-induced cardiotoxicity. To date no reliable association has been made between cancer onset or progression and troponin expression.

Figure 24:
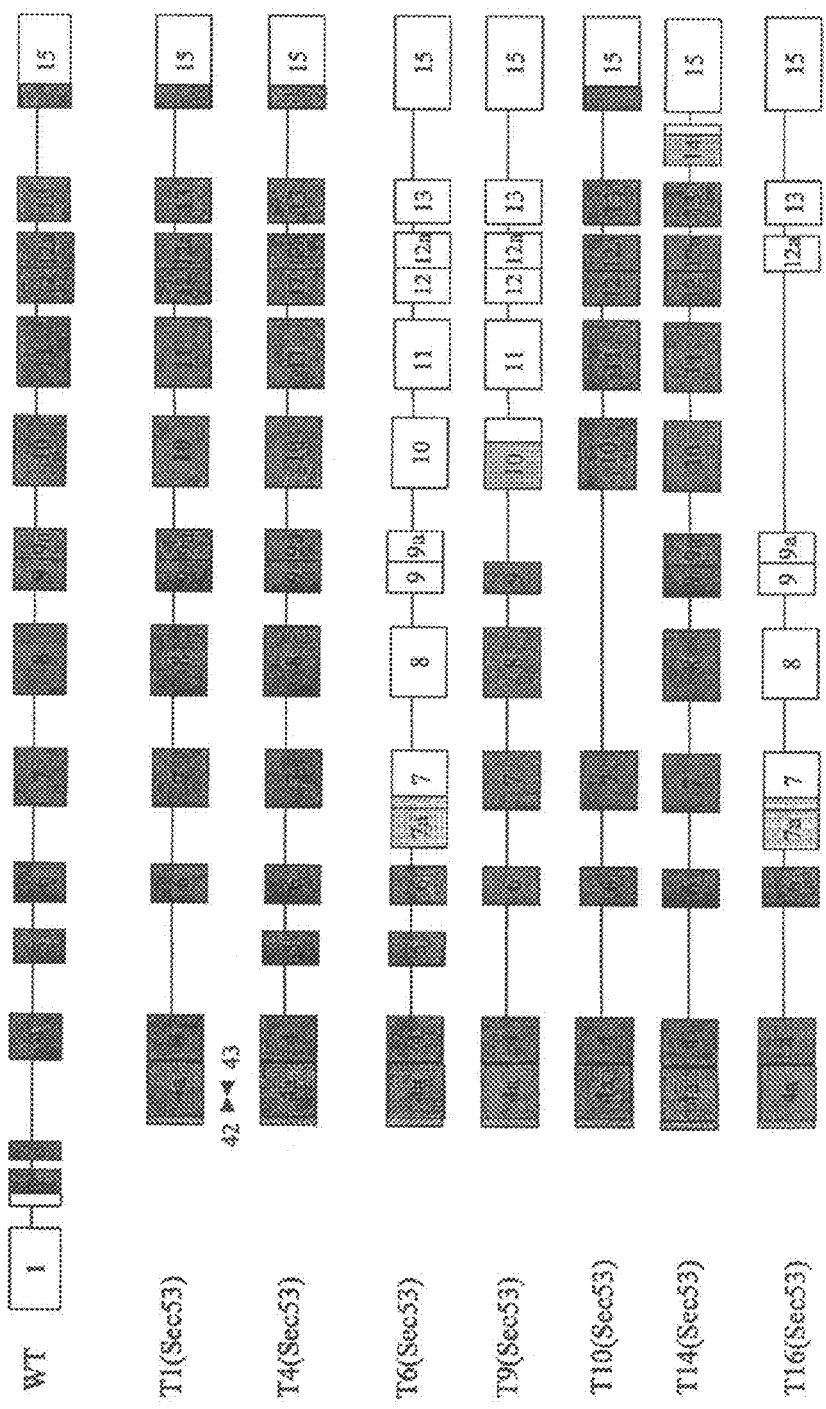
FIG. 24 is an illustration depicting schematic alignment of the nucleic acid sequences of wild type Troponin transcript (GenBank Accession No. NM_003283) and variants 1, 4, 6, 9, 10, 14 and 16 (SEQ ID NOs: 46, 47, 48, 49, 50, 51, 52, and 53, respectively), as described in Example 7 below. Coding regions are shaded. Sequence region 4a codes for the unique amino acid sequence. Other regions marked in dotes code for additional novel amino acids sequences. Red arrows indicate the location of the primers and SEQ ID NOs. thereof, which were used for real-time PCR validation.

By applying the teachings of the present invention, the present inventors uncovered elevated levels of novel troponin isoforms (see FIG. 24 and SEQ ID NOs:46-61) in lung, ovarian and colon cancers, suggesting the use of troponin alone or in combination with wild type troponin for diagnosis and treatment of cancer (see Examples 7a-c).

Materials and Experimental Procedures

RNA preparation—RNA was purchased from various sources including Clontech (Franklin Lakes, N.J. USA 07417), BioChain Inst. Inc., ABS or Ambion. Alternatively, RNA was purified from tissue samples using TRI-Reagent (Molecular Research Center), according to Manufacturer's instructions. Tissue samples were obtained from cancer patients or from postmortem. Total RNA samples were treated with DNaseI (Ambion) then purified using RNeasy columns (Qiagen).

RT PCR—1 µg of DNaseI-treated RNA was mixed with 150 ng of Random Hexamer primers (Invitrogen) and 500 µM dNTP in a total volume of 15.6 µl. The mixture was incubated for 5 min at 65° C. and then quickly chilled on ice. Thereafter, 5 µl of 5× SuperscriptII first strand buffer (Invitrogen), 2.4 µl of 0.1M DTT and 40 units RNasin (Promega) were added, and the mixture was incubated for 10 minutes at 25° C., followed by a 2-minutes at 42° C. Reverse transcription was effected by the addition of 1 µl (200 units) of SuperscriptII (Invitrogen) to the reaction mixture (final volume of 25 µl) and incubation at 42° C. for 50 minutes, following which the enzyme was inactivated at 70° C. for 15 minutes. The resulting cDNA was diluted 1:20 in TE (10 mM Tris pH=8, 1 mM EDTA pH=8).

Real-Time RT-PCR analysis—5 µl of diluted cDNA generated as described above were used as a template in Real-Time PCR reactions using the SYBR Green I assay (PE Applied Biosystem) with specific primers (for example, SEQ ID NOs:42 and 43). UNG Enzyme (Eurogentech Cat. No. 2L, or ABI Cat. No. D12107 or Roche Cat. No. 10232921) was also included in the reactions. The gene-specific amplification was effected as follows: 50° C. for 2 minutes, 95° C. for 10 minutes, and then 40 cycles of 95° C. for 15 seconds, followed by 60° C. for 1 minute. Detection was effected using the SDS 7000 apparatus (PE Applied Biosystem). The cycle in which the reactions achieved a threshold level (Ct) of fluorescence was registered and served to calculate the relative transcript quantity in the RT reactions. The relative quantity was calculated using the following equation: Q=efficiency^-Ct. The efficiency of the PCR reaction was calculated from a standard curve created using serial dilutions of reverse transcription (RT) reactions prepared from RNA purified from 5 cell-lines (HCT116, H1299, DU145, MCF7, ES-2). To minimize inherent differences in the RT reaction, the resulting relative quantities were normalized to the geometric mean of the relative quantities of several housekeeping genes.

Detection of the expression level of troponin isoforms in normal, benign and cancerous ovary tissues—Expression of the troponin isoforms of the present invention (S69208_unique_region; SEQ ID NO:45) was measured by real time PCR using a fragment derived therefrom (amplicon—SEQ ID NO:23, primers are set forth in SEQ ID NOs: 21 and 22). In addition the expression of four housekeeping genes—PBGD (GenBank Accession No. BC019323; amplicon—SEQ ID NO:32; Forward primer—SEQ ID NO:30; Reverse primer—SEQ ID NO:31), HPRT (GenBank Accession No. NM_000194; amplicon—SEQ ID NO:29; Forward primer—SEQ ID NO:27; Reverse primer—SEQ ID NO:28), GAPDH (GenBank Accession No. BC026907; amplicon—SEQ ID NO:35; Forward primer—SEQ ID NO:33; Reverse primer—SEQ ID NO:34) and SDHA (GenBank Accession No. NM_004168; amplicon—SEQ ID NO:26; Forward primer—SEQ ID NO:24; Reverse primer—SEQ ID NO:25) was measured by real time PCR. In each RT sample, the expression level of troponin-S69208_unique_region amplicon (SEQ ID NO:23) was normalized to the geometric mean of the quantities of the housekeeping genes. The normalized quantity of each RT sample was then divided by the averaged quantity of the normal post-mortem samples (no. 45-48, 71, Table 3, hereinbelow) to obtain a value of fold up-regulation of each sample relative to averaged normal samples.

Detection of the expression level of troponin isoforms in normal and cancerous lung tissues—was performed as described hereinabove for ovary tissues except that the expression level of Ubiquitin (GenBank Accession No. BC000449; amplicon—SEQ ID NO:38; forward primer—SEQ ID NO:36; reverse primer—SEQ ID NO:37) was determined instead of that of GAPDH and was used to normalize the expression level of the troponin-S69208_unique_region amplicon (SEQ ID NO:23). The normalized quantity of each RT sample was then divided by the averaged quantity of the normal post-mortem samples (no. 47-50, 90-93, 96-99, Table 4, hereinbelow) to obtain a value of fold up-regulation of each sample relative to averaged normal samples.

Detection of the expression level of troponin isoforms in normal and cancerous colon tissues—was performed as described hereinabove for ovary tissues except that the expression level of RPS27A (GenBank Accession No. NM_002954; amplicon—SEQ ID NO:44; forward primer—SEQ ID NO:42; reverse primer—SEQ ID NO:43) and G6PD (GenBank Accession No. NM_000402; amplicon—SEQ ID NO:41; forward primer—SEQ ID NO:39; reverse primer—SEQ ID NO:40) was determined instead of that of GAPDH and SDHA and was used to normalize the expression level of the troponin-S69208_unique_region amplicon (SEQ ID NO:23). The normalized quantity of each RT sample was then divided by the averaged quantity of the normal post-mortem samples (no. 41,52,62-67, 69-71 Table 5, hereinbelow) to obtain a value of fold up-regulation of each sample relative to averaged normal samples.

Experimental Results

Figure 25:
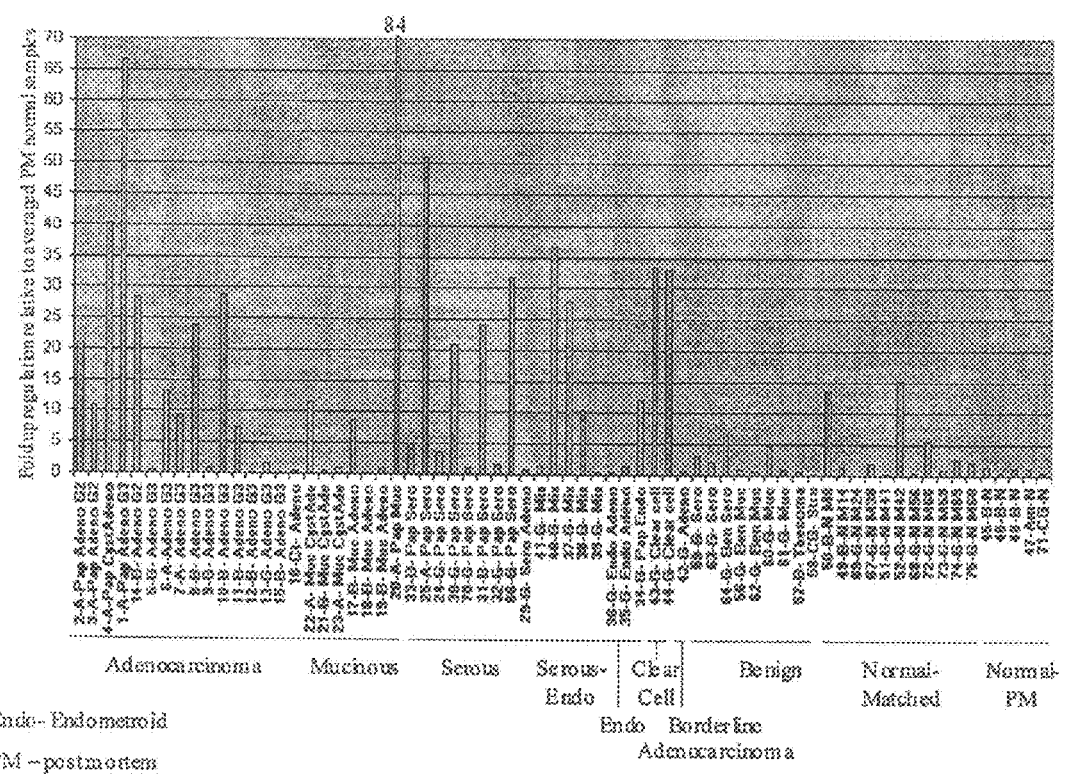
FIG. 25 is a histogram depicting the expression of troponin transcripts of the present invention in normal, benign and tumor derived ovarian samples as determined by real time PCR using a troponin-S69208_unique_region derived fragment (amplicon—SEQ ID NO:23; forward primer—SEQ ID NO:21; reverse primer—SEQ ID NO:22), as described in Example 7 of the Examples section which follows. Expression was normalized to the averaged expression of four housekeeping genes PBGD, HPRT, GAPDH and SDHA.

Expression of troponin isoforms in normal, benign and cancerous ovary tissues—As shown in FIG. 25, the expression of troponin-S69208_unique_region (SEQ ID NO:23) in normal samples (samples no. 45-52, 67-69, 71-75, Table 3, hereinbelow) and benign samples (samples 56-64, Table 2, hereinbelow) was significantly lower than in cancerous samples. Notably, troponin-S69208_unique_region up-regulation of at least 10 fold was found in 8 out of 15 adenocacinoma, 2 out of 7 Mucinus adenocarcinoma, 4 out of 9 Serous adenocarcinoma, 3 out of 5 mix serous-endometroid adenocarcinoma, 1 out of 3 endometroid adenocarcinoma, and in 2 of 2 clear-cell adenocarcinoma samples. A 10-15 fold up-regulation was observed also in 2 of the 11 matched normal samples. However, since matched samples are histologically non-cancerous tissue that surrounds the tumor, such samples could have been contaminated with cancer or pre-cancer cells.

TABLE 2

| Sample name | Lot number | Source | Tissue | Pathology |
|---|---|---|---|---|
| 2-A-Pap Adeno G2 | ILS-1408 | ABS | ovary | Papillary adenocarcinoma |
| 3-A-Pap Adeno G2 | ILS-1431 | ABS | ovary | Papillary adenocarcinoma |
| 4-A-Pap CystAdeno G2 | ILS-7286 | ABS | ovary | Papillary cystadenocarcinoma |
| 1-A-Pap Adeno G3 | ILS-1406 | ABS | ovary | Papillary adenocarcinoma |
| 14-B-Adeno G2 | A501111 | BioChain | ovary | Adenocarcinoma |
| 5-G-Adeno G3 | 99-12-G432 | GOG | ovary | Adenocarcinoma (Stage3C) |
| 6-A-Adeno G3 | A0106 | ABS | ovary | adenocarcinoma |
| 7-A-Adeno G3 | IND-00375 | ABS | ovary | adenocarcinoma |
| 8-B-Adeno G3 | A501113 | BioChain | ovary | adenocarcinoma |
| 9-G-Adeno G3 | 99-06-G901 | GOG | ovary | Adenocarcinoma (maybe serous) |
| 10-B-Adeno G3 | A407069 | Biochain | ovary | Adenocarcinoma |
| 11-B-Adeno G3 | A407068 | Biochain | ovary | Adenocarcinoma |
| 12-B-Adeno G3 | A406023 | Biochain | ovary | Adenocarcinoma |
| 13-G-Adeno G3 | 94-05-7603 | GOG | right ovary | Metastasis adenocarcinoma |
| 15-B-Adeno G3 | A407065 | BioChain | ovary | Carcinoma |
| 16-Ct-Adeno | 1090387 | Clontech | ovary | Carcinoma NOS |
| 22-A-Muc CystAde G2 | A0139 | ABS | ovary | Mucinous cystadenocarcinoma (Stage1C) |
| 21-G-Muc CystAde G2-3 | 95-10-G020 | GOG | ovary | Mucinous cystadenocarcinoma (Stage2) |
| 23-A-Muc CystAde G3 | VNM-00187 | ABS | ovary | Mucinous cystadenocarcinoma with low malignant |
| 17-B-Muc Adeno G3 | A504084 | BioChain | ovary | Mucinous adenocarcinoma |
| 18-B-Muc Adeno G3 | A504083 | BioChain | ovary | Mucinous adenocarcinoma |
| 19-B-Muc Adeno G3 | A504085 | BioChain | ovary | Mucinous adenocarcinoma |
| 20-A-Pap Muc CystAde | USA-00273 | ABS | ovary | Papillary mucinous cystadenocarcinoma |
| 33-B-Pap Sero CystAde G1 | A503175 | BioChain | ovary | Serous papillary cystadenocarcinoma |
| 25-A-Pap Sero Adeno G3 | N0021 | ABS | ovary | Papillary serous adenocarcinoma (StageT3CN1MX) |
| 24-G-Pap Sero Adeno G3 | 2001-07-G801 | GOG | ovary | Papillary serous adenocarcinoma |
| 30-G-Pap Sero Adeno G3 | 2001-08-G011 | GOG | ovary | Papillary serous carcinoma (Stage1C) |

TABLE 2-continued

| Sample name | Lot number | Source | Tissue | Pathology |
|---|---|---|---|---|
| 70-G-Pap Sero Adeno G3 | 95-08-G069 | GOG | ovary | Papillary serous adenocarcinoma |
| 31-B-Pap Sero CystAde G3 | A503176 | BioChain | ovary | Serous papillary cystadenocarcinoma |
| 32-G-Pap Sero CystAde G3 | 93-09-4901 | GOG | ovary | Serous papillary cystadenocarcinoma |
| 66-G-Pap Sero Adeno G3 SIV | 2000-01-G413 | GOG | ovary | Papillary serous carcinoma (metastais of primary peritoneum) (Stage4) |
| 29-G-Sero Adeno G3 | 2001-12-G035 | GOG | right ovary | Serous adenocarcinoma (Stage3A) |
| 41-G-Mix Sero/Muc/Endo G2 | 98-03-G803 | GOG | ovary | Mixed epithelial cystadenocarcinoma with mucinous, endometrioid, squamous and papillary serous (Stage2) |
| 40-G-Mix Sero/Endo G2 | 95-11-G006 | GOG | ovary, endometrium | Papillary serous and endometrioid cystadenocarcinoma (Stage3C) |
| 37-G-Mix Sero/Endo G3 | 2002-05-G513 | GOG | ovary | Mixed serous and endometrioid adenocarcinoma |
| 38-G-Mix Sero/Endo G3 | 2002-05-G509 | GOG | ovary | Mixed serous and endometrioid adenocarcinoma of mullerian (Stage3C) |
| 39--G-Mix Sero/Endo G3 | 2001-12-G037 | GOG | ovary | Mixed serous and endometrioid adenocarcinoma |
| 36-G-Endo Adeno G1-2 | 2000-09-G621 | GOG | ovary | Endometrial adenocarcinoma |
| 35-G-Endo Adeno G2 | 94-08-7604 | GOG | right ovary | Endometrioid adenocarcinoma |
| 34-G-Pap Endo Adeno G3 | 95-04-2002 | GOG | ovary | Papillary endometrioid adenocarcinoma (Stage3C) |
| 43-G-Clear cell Adeno G3 | 2001-10-G002 | GOG | ovary | Clear cell adenocarcinoma |
| 44-G-Clear cell Adeno | 2001-07-G084 | GOG | ovary | Clear cell adenocarcinoma (Stage3A) |
| 42-G-Adeno borderline | 98-08-G001 | GOG | ovary | Epithelial adenocarcinoma of borderline malignancy |
| 59-G-Sero CysAdenoFibroma | 98-12-G401 | GOG | ovary | Serous CysAdenoFibroma |
| 63-G-Sero CysAdenoFibroma | 2000-10-G620 | GOG | ovary | Serous CysAdenoFibroma of borderline malignancy |
| 64-G-Ben Sero CysAdenoma | 99-06-G039 | GOG | ovary | Bengin Serous CysAdenoma |
| 56-G-Ben Muc CysAdeno | 99-01-G407 | GOG | left ovary | Bengin mucinus cysadenoma |
| 62-G-Ben Muc CysAdenoma | 99-10-G442 | GOG | ovary | Bengin mucinus cysadenoma |
| 60-G-Muc CysAdenoma | 99-01-G043 | GOG | ovary | Mucinous Cysadenoma |
| 61-G-Muc CysAdenoma | 99-07-G011 | GOG | ovary | Mucinous Cysadenoma |
| 57-B-Thecoma | A407066 | BioChain | ovary | Thecoma |
| 58-CG-Stru teratoma | CG-177 | Ichilov | ovary | Struma ovary/monodermal teratoma |
| 50-B-N M8 | A501114 | BioChain | ovary | Normal (matched tumor A501113) |
| 49-B-N M14 | A501112 | BioChain | ovary | Normal (matched tumor A501111) |
| 69-G-N M24 | 2001-07-G801N | GOG | ovary | Normal (matched tumor 2001-07-G801) |
| 67-G-N M38 | 2002-05-509N | GOG | ovary | Normal (matched tumor 2002-05-G509) |
| 51-G-N M41 | 98-03-G803N | GOG | ovary | Normal (matched tumor 98-03-G803) |
| 52-G-N M42 | 98-08-G001N | GOG | ovary | Normal (matched |

TABLE 2-continued

| Sample name | Lot number | Source | Tissue | Pathology |
|---|---|---|---|---|
| | | | | tumor 98-08-G001) |
| 68-G-N M56 | 99-01-G407N | GOG | ovary | Normal (matched bengin 99-01-G407) |
| 72-G-N M66 | 2000-01-G413N | GOG | ovary | Normal (matched tumor 2000-01-G413) |
| 73-G-N M59 | 98-12-G401N | GOG | ovary | Normal (matched tumor 98-12-G401) |
| 74-G-N M65 | 97-11-G320N | GOG | ovary | Normal (matched tumor 97-11G320) |
| 75-G-N M60 | 99-01-G043N | GOG | ovary | Normal (matched tumor 99-01-G043) |
| 45-B-N | A503274 | BioChain | ovary | Normal PM |
| 46-B-N | A504086 | BioChain | ovary | Normal PM |
| 48-B-N | A504087 | BioChain | ovary | Normal PM |
| 47-Am-N | 061P43A | Ambion | ovary | Normal PM |
| 71-CG-N | CG-188-7 | Ichilov | ovary | Normal PM |

Figure 26:
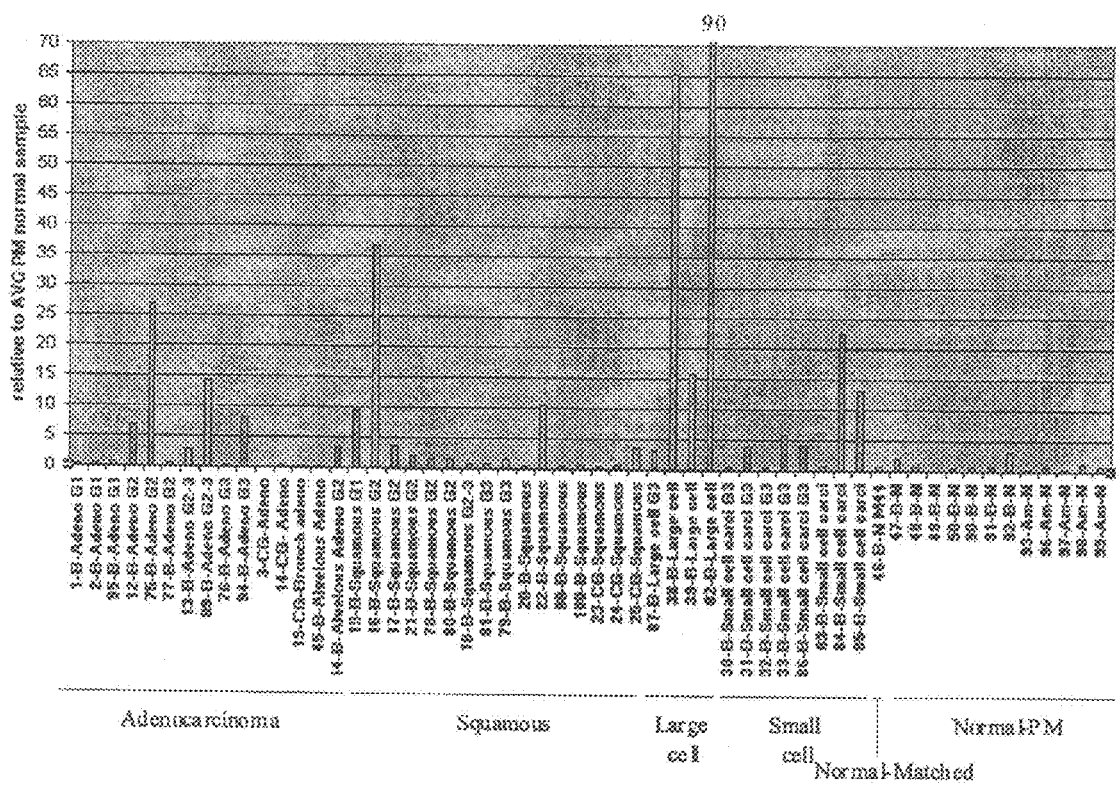
FIG. 26 is a histogram depicting the expression of troponin transcripts of the present invention in normal and tumor derived lung samples as determined by real time PCR using a troponin-S69208_unique_region derived fragment (amplicon—SEQ ID NO:23; forward primer—SEQ ID NO:21; reverse primer—SEQ ID NO:22), as described in Example 7 of the Examples section which follows. Expression was normalized to the averaged expression of four housekeeping genes PBGD, HPRT, Ubiquitin and SDHA.

Expression level of troponin isoforms in normal and cancerous lung tissues—As shown in FIG. 26, the expression of troponin-S69208_unique_region (SEQ ID NO:23) was upregulated in several cancer samples relative to the normal samples. Specifically, troponin-S69208_unique_region up-regulation of at least 10 fold was found in 2 of 15 adenocarcinoma, 2 out of 16 squamous, 3 out of 4 large cell, and 2 out of 8 small cell samples. Notably, up-regulation of troponin-S69208_unique_region seems to be more specific to large cell tumors.

TABLE 3

| Sample rename | Lot No. | Source | Pathology | Grade | Gender/age |
|---|---|---|---|---|---|
| 1-B-Adeno G1 | A504117 | Biochain | Adenocarcinoma | 1 | F/29 |
| 2-B-Adeno G1 | A504118 | Biochain | Adenocarcinoma | 1 | M/64 |
| 95-B-Adeno G1 | A610063 | Biochain | Adenocarcinoma | 1 | F/54 |
| 12-B-Adeno G2 | A504119 | Biochain | Adenocarcinoma | 2 | F/74 |
| 75-B-Adeno G2 | A609217 | Biochain | Adenocarcinoma | 2 | M/65 |
| 77-B-Adeno G2 | A608301 | Biochain | Adenocarcinoma | 2 | M/44 |
| 13-B-Adeno G2-3 | A504116 | Biochain | Adenocarcinoma | 2-3 | M/64 |
| 89-B-Adeno G2-3 | A609077 | Biochain | Adenocarcinoma | 2-3 | M/62 |
| 76-B-Adeno G3 | A609218 | Biochain | Adenocarcinoma | 3 | M/57 |
| 94-B-Adeno G3 | A610118 | Biochain | Adenocarcinoma | 3 | M/68 |
| 3-CG-Adeno | CG-200 | Ichilov | Adenocarcinoma | | NA |
| 14-CG-Adeno | CG-111 | Ichilov | Adenocarcinoma | | M/68 |
| 15-CG-Bronch adeno | CG-244 | Ichilov | Bronchioloalveolar adenocarcinoma | | M/74 |
| 45-B-Alvelous Adeno | A501221 | Biochain | Alveolus carcinoma | | F/50 |
| 44-B-Alvelous Adeno G2 | A501123 | Biochain | Alveolus carcinoma | 2 | F/61 |
| 19-B-Squamous G1 | A408175 | Biochain | Squamous carcinoma | 1 | M/78 |
| 16-B-Squamous G2 | A409091 | Biochain | Squamous carcinoma | 2 | F/68 |
| 17-B-Squamous G2 | A503183 | Biochain | Squamous carcinoma | 2 | M/57 |
| 21-B-Squamous G2 | A503187 | Biochain | Squamous carcinoma | 2 | M/52 |
| 78-B-Squamous G2 | A607125 | Biochain | Squamous Cell Carcinoma | 2 | M/62 |
| 80-B-Squamous G2 | A609163 | Biochain | Squamous Cell Carcinoma | 2 | M/74 |
| 18-B-Squamous G2-3 | A503387 | Biochain | Squamous Cell Carcinoma | 2-3 | M/63 |
| 81-B-Squamous G3 | A609076 | Biochain | Squamous Carcinoma | 3 | m/53 |
| 79-B-Squamous G3 | A609018 | Biochain | Squamous Cell Carcinoma | 3 | M/67 |
| 20-B-Squamous | A501121 | Biochain | Squamous Carcinoma | | M/64 |
| 22-B-Squamous | A503386 | Biochain | Squamous Carcinoma | | M/48 |
| 88-B-Squamous | A609219 | Biochain | Squamous Cell Carcinoma | | M/64 |
| 100-B-Squamous | A409017 | Biochain | Squamous Carcinoma | | M/64 |
| 23-CG-Squamous | CG-109 (1) | Ichilov | Squamous Carcinoma | | M/65 |
| 24-CG-Squamous | CG-123 | Ichilov | Squamous Carcinoma | | M/76 |

TABLE 3-continued

| Sample rename | Lot No. | Source | Pathology | Grade | Gender/age |
|---|---|---|---|---|---|
| 25-CG-Squamous | CG-204 | Ichilov | Squamous Carcinoma | | M/72 |
| 87-B-Large cell G3 | A609165 | Biochain | Large Cell Carcinoma | 3 | F/47 |
| 38-B-Large cell | A504113 | Biochain | Large cell | | M/58 |
| 39-B-Large cell | A504114 | Biochain | Large cell | | F/35 |
| 82-B-Large cell | A609170 | Biochain | Large Cell Neuroendocrine Carcinoma | | M/68 |
| 30-B-Small cell carci G3 | A501389 | Biochain | small cell | 3 | M/34 |
| 31-B-Small cell carci G3 | A501390 | Biochain | small cell | 3 | F/59 |
| 32-B-Small cell carci G3 | A501391 | Biochain | small cell | 3 | M/30 |
| 33-B-Small cell carci G3 | A504115 | Biochain | small cell | 3 | M |
| 86-B-Small cell carci G3 | A608032 | Biochain | Small Cell Carcinoma | 3 | F/52 |
| 83-B-Small cell carci | A609162 | Biochain | Small Cell Carcinoma | | F/47 |
| 84-B-Small cell carci | A609167 | Biochain | Small Cell Carcinoma | | F/59 |
| 85-B-Small cell carci | A609169 | Biochain | Small Cell Carcinoma | | M/66 |
| 46-B-N M44 | A501124 | Biochain | Normal M44 | | F/61 |
| 47-B-N | A503205 | Biochain | Normal PM | | M/26 |
| 48-B-N | A503206 | Biochain | Normal PM | | M/44 |
| 49-B-N | A503384 | Biochain | Normal PM | | M/27 |
| 50-B-N | A503385 | Biochain | Normal PM | | M/28 |
| 90-B-N | A608152 | Biochain | Normal (Pool 2) PM | | pool 2 |
| 91-B-N | A607257 | Biochain | Normal (Pool 2) PM | | pool 2 |
| 92-B-N | A503204 | Biochain | Normal PM | | m/28 |
| 93-Am-N | 111P0103A | Ambion | Normal ICH | | F/61 |
| 96-Am-N | 36853 | Ambion | Normal PM | | F/43 |
| 97-Am-N | 36854 | Ambion | Normal PM | | M/46 |
| 98-Am-N | 36855 | Ambion | Normal PM | | F/72 |
| 99-Am-N | 36856 | Ambion | Normal PM | | M/31 |

Figure 27:
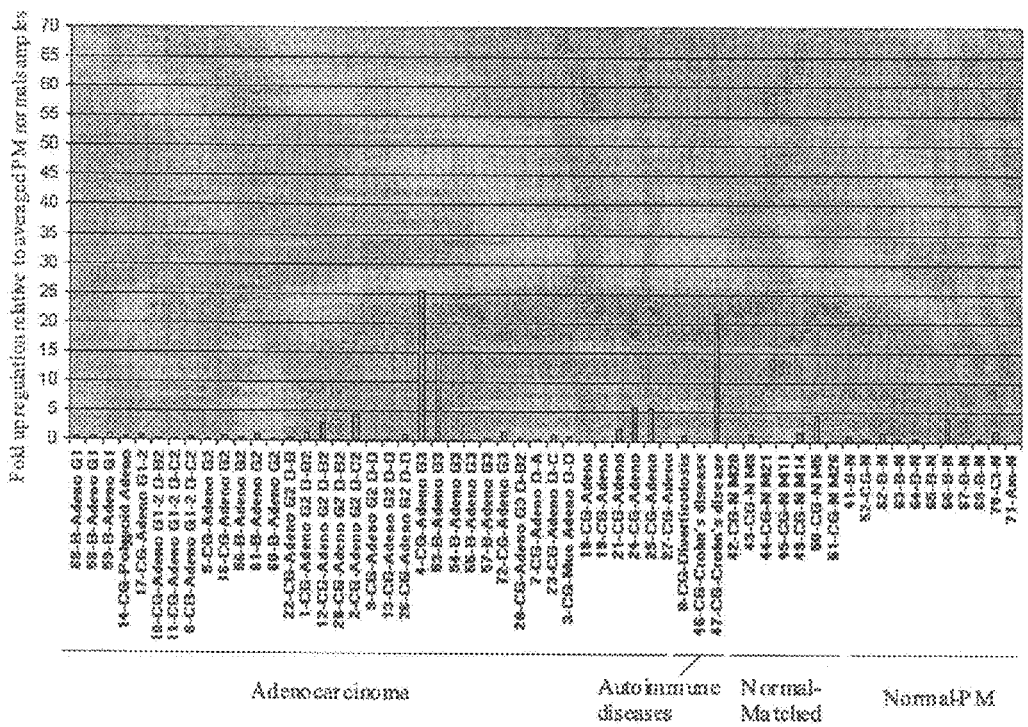
FIG. 27 is a histogram depicting the expression of troponin transcripts for the present invention in non-cancerous, and tumor derived colon samples as determined by real time PCR using a troponin-S69208_unique_region derived fragment (SEQ ID NOs:23-amplicon), as described in Example 7c below. Expression was normalized to the averaged expression of four housekeeping genes PBGD, HPRT, RPS27A and G6PD.

Expression of troponin isoforms in normal and cancerous colon tissues—As shown in FIG. 27, the expression of troponin-S69208_unique_region was upregulated at least 10 fold (4 samples showed at least 5 fold) in two cancer samples relative to the normal samples. One of the 3 autoimmune disease samples also showed up-regulation in the expression of troponin S69208_unique_region.

TABLE 4

| Sample rename | Lot No. | Tissue | Source | Pathology |
|---|---|---|---|---|
| 68-B-Adeno G1 | A610024 | Sigmoid colon | biochain | Adenocarcinoma |
| 58-B-Adeno G1 | A609152 | Colon | biochain | Adenocarcinoma |
| 59-B-Adeno G1 | A609059 | Colon | biochain | Adenocarcinoma, Ulcer |
| 14-CG-Polypoid Adeno G1 D-C | CG-222 (2) | Rectum | Ichilov | Well polypoid adeocarcinoma Duke's C |
| 17-CG-Adeno G1-2 | CG-163 | Rectum | Ichilov | Adenocarcinoma |
| 10-CG-Adeno G1-2 D-B2 | CG-311 | Sigmod colon | Ichilov | Adenocarcinoma Astler-Coller B2. |
| 11-CG-Adeno G1-2 D-C2 | CG-337 | Colon | Ichilov | Adenocarcinoma Astler-Coller C2. |
| 6-CG-Adeno G1-2 D-C2 | CG-303 (3) | Colon | Ichilov | Adenocarcinoma Astler-Coller C2. |
| 5-CG-Adeno G2 | CG-308 | Colon Sigma | Ichilov | Adenocarcinoma. |
| 16-CG-Adeno G2 | CG-278C | colon | Ichilov | Adenocarcinoma |
| 56-B-Adeno G2 | A609148 | Colon | biochain | Adenocarcinoma |
| 61-B-Adeno G2 | A606258 | Colon | biochain | Adenocarcinoma, Ulcer |
| 60-B-Adeno G2 | A609058 | Colon | biochain | Adenocarcinoma, Ulcer |
| 22-CG-Adeno G2 D-B | CG-229C | Colon | Ichilov | Adenocarcinoma Duke's B |
| 1-CG-Adeno G2 D-B2 | CG-335 | Cecum | Ichilov | Adenocarcinoma Dukes B2. |
| 12-CG-Adeno G2 D-B2 | CG-340 | Colon Sigma | Ichilov | Adenocarcinoma Astler-Coller B2. |
| 28-CG-Adeno G2 D-B2 | CG-284 | sigma | Ichilov | Adenocarcinoma Duke's B2 |
| 2-CG-Adeno G2 | CG-307 X2 | Cecum | Ichilov | Adenocarcinoma Astler-Coller |

TABLE 4-continued

| Sample rename | Lot No. | Tissue | Source | Pathology |
|---|---|---|---|---|
| D-C2 | | | | C2. |
| 9-CG-Adeno G2 D-D | CG-297 X2 | Rectum | Ichilov | Adenocarcinoma Dukes D. |
| 13-CG-Adeno G2 D-D | CG-290 X2 | Rectosigmodal colon | Ichilov | Adenocarcinoma Dukes D. |
| 26-CG-Adeno G2 D-D | CG-283 | sigma | Ichilov | Colonic adenocarcinoma Duke's D |
| 4-CG-Adeno G3 | CG-276 | Colon | Ichilov | Carcinoma. |
| 53-B-Adeno G3 | A609161 | Colon | biochain | Adenocarcinoma |
| 54-B-Adeno G3 | A609142 | Colon | biochain | Adenocarcinoma |
| 55-B-Adeno G3 | A609144 | Colon | biochain | Adenocarcinoma |
| 57-B-Adeno G3 | A609150 | Colon | biochain | Adenocarcinoma |
| 72-CG-Adeno G3 | CG-309 | colon | Ichilov | Adenocarcinoma |
| 20-CG-Adeno G3 D-B2 | CG-249 | Colon | Ichilov | Ulcerated adenocarcinoma Duke's B2 |
| 7-CG-Adeno D-A | CG-235 | Rectum | Ichilov | Adenocarcinoma intramucosal Duke's A. |
| 23-CG-Adeno D-C | CG-282 | sigma | Ichilov | Mucinus adenocarcinoma Astler Coller C |
| 3-CG-Muc adeno D-D | CG-224 | Colon | Ichilov | Mucinois adenocarcinoma Duke's D |
| 18-CG-Adeno | CG-22C | Colon | Ichilov | Adenocarcinoma |
| 19-CG-Adeno | CG-19C (1) | Colon | Ichilov | Adenocarcinoma |
| 21-CG-Adeno | CG-18C | Colon | Ichilov | Adenocarcinoma |
| 24-CG-Adeno | CG-12 (2) | Colon | Ichilov | Adenocarcinoma |
| 25-CG-Adeno | CG-2 | Colon | Ichilov | Adenocarcinoma |
| 27-CG-Adeno | CG-4 | Colon | Ichilov | Adenocarcinoma |
| 8-CG-diverticolosis, diverticulitis | CG-291 | Wall of sigma | Ichilov | Diverticolosis and diverticulitis of the Colon |
| 46-CG-Crohn's disease | CG-338C | Cecum | Ichilov | Crohn's disease |
| 47-CG-Crohn's disease | CG-338AC | Colon | Ichilov | Crohn's disease. |
| 42-CG-N M20 | CG-249N | Colon | Ichilov | Normal |
| 43-CG-N M8 | CG-291N | Wall of sigma | Ichilov | Normal |
| 44-CG-N M21 | CG-18N | Colon | Ichilov | Normal |
| 45-CG-N M11 | CG-337N | Colon | Ichilov | Normal |
| 49-CG-N M14 | CG-222N | Rectum | Ichilov | Normal |
| 50-CG-N M5 | CG-308N | Sigma | Ichilov | Within normal limits |
| 51-CG-N M26 | CG-283N | Sigma | Ichilov | Normal |
| 41-B-N | A501156 | Colon | biochain | Normal PM |
| 52-CG-N | CG-309TR | Colon | Ichilov | Within normal limits |
| 62-B-N | A608273 | Colon | biochain | Normal PM |
| 63-B-N | A609260 | Colon | biochain | Normal PM |
| 64-B-N | A609261 | Colon | biochain | Normal PM |
| 65-B-N | A607115 | Colon | biochain | Normal PM |
| 66-B-N | A609262 | Colon | biochain | Normal PM |
| 67-B-N | A406029 | Colon | biochain | Normal PM (Pool 10) |
| 69-B-N | A411078 | Colon | biochain | Normal PM (Pool 10) |
| 70-Cl-N | 1110101 | Colon | clontech | Normal PM (Pool of 3) |
| 71-Am-N | 071P10B | Colon | Ambion | Normal (IC BLEED) |

Thus, these results demonstrate that troponin S69208_unique_region (SEQ ID NO:45) is upregulated in various cancers including lung, ovarian and colon cancers.

While reducing the present invention to practice, the present inventors have uncovered that the troponin variant of the present invention (SEQ ID NO:45), the PCR amplicon (SEQ ID NO:23) and/or the PCR primers (SEQ ID NO:21 and 22) used to detect such a variant, alone or in any combination thereof, can be used as diagnostic markers for diagnosing cancers (e.g., lung, ovarian and colon cancers). Detection of the expression level of the troponin variant of the present invention can be effected using methods immunological assays [e.g., Western Blot, immunohistochemistry, FACS analysis, radio immuno assay (RIA), immunofluorescence and the like, using an antibody directed against the troponin variant (SEQ ID NO:54), or by nucleic acid techniques (NAT) such as RT-PCR, Northern Blot, in situ hybridization, in situ RT-PCR.

While further reducing the present invention to practice, the present inventors have uncovered a method and pharmaceutical compositions for treating a troponin—related cancer (e.g., lung, ovarian and colon cancers). The method comprising downregulating the expression level and/or activity of at least one troponiin variant, a polypeptide homologous to SEQ ID NO:54, to thereby treat the troponin—related cancer. Downregulating is effected using an agent selected from the group consisting of a troponin S69208_unique_region specific antisense oligonucleotide, a troponin S69208_unique_region specific siRNA, a troponin S69208_unique_region specific DNAzyme, a troponin S69208_unique_region specific Ribozyme, a troponin S69208_unique_region specific antibody, and a non-functional analogue of the troponin S69208_unique_region. Such an agent is provided at a therapeutic concentration along with a pharmaceutically acceptable carrier (e.g., PEG and liposomes).

Example 8

Splice Variant of Integrin Alpha-M Precursor

Background

Integrin αM associates in a non-covalent manner with β2 and generates the leukocyte membrane glycoprotein known as Mac-1, CR3, CD11b/CD18, or αMβ2-integrin. Mac-1 is one of four members of leukocyte-restricted β2-integrin family. It is expressed by granulocytes, monocytes, macrophages, dendritic cells, neutrophils eosenophils, natural killers (NKs) and some specific subsets of T and B lymphocytes. The expression and functional activity of Mac-1 is regulated during leukocyte differentiation and activation. Mac-1 is stored in intracellular vesicular compartments and is rapidly mobilized to the surface upon chemoattractants or other cellular stimuli. Mac-1 has two distinct functions; it mediates the migration of myeloid leukocytes and NKs out of blood vessels and into inflammatory sites by generating a high affinity binding site for intercellular adhesion molecule-1 (ICAM-1) expressed by activated endothelium. Additionally, as complement receptor type 3 (CR3), it mediates phagocytosis and cytotoxic degranulation in response to microorganisms or immune complexes opsonized with iC3b. It also forms complexes with other membrane glycoproteins, functioning as signal transducing partners for them. For this purpose, Mac-1 goes through series of "inside-out" and/or "outside-in" signaling steps that result in exposure of high affinity binding sites and/or an altered linkage to cytoskeletal elements (Ross, 2000, Critical Reviews in Immunology 20:197-222).

Figure 48:
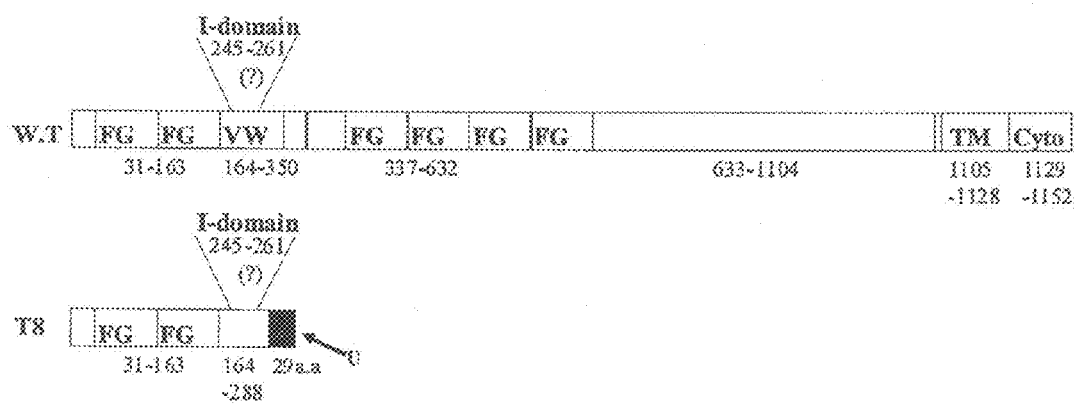
FIG. 48 is a schematic illustration showing the protein domain structure of wild-type Integrin alpha-M (SwissProt locus: ITAM_HUMAN; SEQ ID NO:141) and the variant of the present invention (SEQ ID NO:77). Unique region is indicated by U and arrow (SEQ ID NO:79).

As is shown in FIG. 48, the extracellular portion of Mac-1 encompasses seven (I-VII) homologues tandem repeats (FG-GAPS). Between FG-GAP II-III there is a von Willebrand sequence that contains the I-domain, which includes the binding site for all known protein ligands of Mac-1. A conformational shift that occurs upon binding a metal cation to MIDAS (metal-ion-dependent adhesion site) is responsible for the ligand binding activity of the I-domain (Takagi and Springer, 2002, Immunological Reviews 186:141-163). Domains V-VII contain putative divalent cation binding sites (also designated EF-hands). The seven FG-GAPS fold into a β propeller structure. The extracellular C-terminal region was found to contain a lectin-like site, which was shown to mediate both adhesion and cytotoxicity. Additionally Mac-1 has a transmembrane domain and a cytoplasmic tail.

Mac-1 recognizes a wide variety of ligands including collagen, fibronectin, heparan sulfate, ICAM-1, the complement component iC3b, Neutrophil inhibitory factor (NIF), factor X, and lipopolysaccharide (LPS) [Ross, 2000 (Supra)].

Clinical Applications

Increased expression of Mac-1 on circulating leukocytes occurs in several inflammatory disorders associated with neutrophil and monocyte activation e.g., in patients with burns, sepsis, hemodialysis, systemic lupus erythromatosis, diabetes mellitus, and in coronary artery disease. Neutrophil accumulation has been also demonstrated in ischemia reperfusion injury. Mac-1 deficiencies eliminate or markedly attenuate acute cellular inflammatory responses in vivo, suggesting that blocking Mac-1 activity may attenuate the tissue damage induced by cells overexpressing Mac-1. Thus, a mAb directed against the integrin αM subunit was found to be efficient in a dog model of myocardial reperfusion injury but only if administered well before reperfusion (Mazzone and Ricevuti, 1995, Haematologica 80:161-175). In addition, a recombinant NIF was tested in a phase II clinical trial as a possible therapeutic agent for the treatment of ischemia [Ross, 2000, (Supra); Takagi and Springer, 2002 (Supra); Mazzone and Ricevuti, 1995, (Supra); Zhou et al., 1994, JBC 269:17075-17079; Ueda et al., 1994, PNAS, 91: 10680-10684].

Splice Variant Structure

The present inventors uncovered a novel splice variant of Integrin alpha M Transcript T8 (HUMLAPA_T8—SEQ ID NO:78, HUMLAPA_P8—SEQ ID NO:77; FIGS. 45*a-b*). The T8 splice variant results from alternative splicing of the integrin αM gene, thus introducing an extension of exon 8 leading to the insertion of a stop codon and the generation of a truncated protein (FIGS. 46-48). This splice variant (SEQ ID NO:78) encodes a 317 amino acids long protein (SEQ ID NO:77), containing 288 amino acids of the wild type sequence, and 29 unique amino acids (NAALRLMLL-WRVSMWIHPPFNLQILLKSK—SEQ ID NO:79). It encompasses the FG-GAPS I and II and part of the von Willebrand domain, while lacking the FG-GAPs III-VII, the lectin domain (whose exact location is unknown), the TM and the cytoplasmic domain (see FIG. 48).

Comparison Report Between HUMLAPA_P8 and ITAM_HUMAN

1. An isolated chimeric polypeptide HUMLAPA_P8 (SEQ ID NO:77), comprising a first amino acid sequence being at least 90% homologous to MALRVLLLTALTLCHG-FNLDTENAMTFQENARGFGQSVVQLQGSRVVVGAP QEIVAANQRGSLYQCDYSTGSCEP-IRLQVPVEAVNMSLGLSLAATTSPPQLLA CGPTVHQTCSENTYVKGLCFLEGSNL-RQQPQKFPEALRGCPQEDSDIAFLIDG SGSIIPHDFR-RMKEFVSTVMEQLKKSKTLFSLMQYSEE-FRIHFIFKEFQNNPNP RSLVKPITQLLGRTHTATGIRKV-VRELFNITNGARKNAFKILVVITDGEKFGDP LGYED-VIPEADREGVIRYVIGVG corresponding to amino acids 1-288 of ITAM_HUMAN (SEQ ID NO:141), which also corresponds to amino acids 1-288 of HUMLAPA_P8 (SEQ ID NO:77), and a second amino acid sequence being at least 70%, optionally at least 80%, preferably at least 85%, more preferably at least 90% and most preferably at least 95% homologous to a polypeptide having the sequence NAALR-LMLLWRVSMWIHPPFNLQILLKSK (SEQ ID NO:79) corresponding to amino acids 289-317 of HUMLAPA_P8 (SEQ ID NO:77), wherein said first amino acid sequence and second amino acid sequence are contiguous and in a sequential order.

2. An isolated polypeptide for a tail of HUMLAPA_P8, comprising a polypeptide being at least 70%, optionally at least about 80%, preferably at least about 85%, more preferably at least about 90% and most preferably at least about 95% homologous to the sequence NAALRLMLLWRVSM-WIHPPFNLQILLKSK (SEQ ID NO:79) in HUMLAPA_P8 (SEQ ID NO:77).

Therapeutic Applications of the Variant

Three potential activities with therapeutic value could be attributed to a soluble αM molecule: (i) competing for dimerization with the β2 subunit and blocking the formation of an active αMβ2 Mac-1 integrin; (ii) competing with Mac-1 for ligand binding and blocking Mac-1-mediated adhesion; and (iii) competing with Mac-1 for binding the complement factor iC3b that mediates phagocytosis of opsonized tumor and bacterial cells.

Zhou et al. (1994, Supra) have demonstrated that recombinant soluble I-domain of αM binds fibrinogen and ICAM-1 (but not factor X) in vitro. The construct used in that work encompasses a larger region of the von Willebrand domain (Gly-127-Ala-334) that is included in the T8 variant of the present invention (SEQ ID NO:77). In addition, Ueda and colleagues (1994, Supra) have shown that immobilized recombinant (rCD11b) I-domain of CD11b is capable of binding complement component-coated erythrocytes (EAiC3b I-domain) in a dose-dependent manner and that such binding is inhibited by soluble rCD11b I-domain. Furthermore, they have shown that a short, linear, I domain peptide (residues 232-245) (i) binds the ligand in a dose dependent manner; (ii) inhibits ligand binding to immobilized rCD11b I-domain, (iii) inhibits binding of erythrocytes to rCD11b I-domain; and (iv) inhibits binding of erythrocytes to neutrophils.

Altogether, these data support a role for T8 (SEQ ID NO:77) as an antagonist of Mac-1 ligand binding and of Mac-1-dependent complement activation.

Thus, the present inventors uncovered a therapeutic agent which can be used to: (i) prevent the dimerization of endogenous αM integrin (SEQ ID NO:141) with β2 (SEQ ID NO:165) and thus block the formation of an active αMβ2 Mac-1 integrin, (ii) prevent the binding of a Mac-1 ligand [e.g., collagen, fibronectin, heparan sulfate, ICAM-1, the complement component iC3b, Neutrophil inhibitory factor (NIF), factor X, and lipopolysaccharide (LPS)] with an endogenous Mac-1 and thus block Mac-1-mediated adhesion (iii) prevent binding of endogenous Mac-1 with the complement factor iC3b and thus prevent Mac-1-mediated phagocytosis of opsonized tumor and bacterial cells, (iv) prevent and/or treat a disorder associated with increased expression of Mac-1 (e.g., increased expression on circulating leukocytes). Such an agent is a polypeptide homologous to the αM variant T8 of the present invention (SEQ ID NO:77), and/or a polynucleotide homologous to SEQ ID NO:78 and/or the peptide derived from the αM variant T8 (SEQ ID NO:79). Such an agent can prevent the binding of a Mac-1 ligand [e.g., collagen, fibronectin, heparan sulfate, ICAM-1, the complement component iC3b, Neutrophil inhibitory factor (NIF), factor X, and lipopolysaccharide (LPS)] or an endogenous β2 (SEQ ID NO:165) with the endogenous αM (SEQ ID NO:141). Non-limiting examples of disorders which can be treated according to this aspect of the present invention include burns, sepsis, hemodialysis, systemic lupus erythromatosis, diabetes mellitus, in coronary artery disease, and ischemia reperfusion injury.

It will be appreciated that such an agent can be administered or provided to an individual in need thereof per se or as part of a pharmaceutical composition with a pharmaceutical acceptable carrier (e.g., PEG and liposomes).

Example 9

Splice Variant of Interferon-Alpha/Beta Receptor Beta Chain Precursor

Background

Type I interferons (IFNs; e.g., IFN-α, IFN-β, IFN-ω, IFN-κ, and IFN-τ) are implicated in both normal and neoplastic cell growth regulation and in modulating both innate and adaptive immune responses to microbial challenge. Thus ISNs exhibit antiviral, antiproliferative, immunomodulatory and developmental activities. All type I IFNs are functionally active as monomers and activate a specific receptor complex composed of two major subunits, IFNAR-1/INR1 and IFNAR-2/INR2. The high affinity interaction between IFN-α/β and its specific cell surface receptor leads to receptor aggregation and the activation of receptor-associated cytoplasmic tyrosine kinases of the Jak family-Jak1 and Tyk2. These in turn phosphorylate intracellular tyrosine residues of the IFNAR-1 and IFNAR-2 chains, that serve as recruitment sites for the signal transducers and activators of transcription (STAT) proteins, Stat 1-5. Once associated with the activated receptor, the STAT become phosphorylated and form both homodimers and heterodimers, which translocate to the nucleus and bind specific DNA sequences within the promoter regions of IFN-sensitive genes (ISG). The Jak-Stat pathway is an essential signaling pathway for the transcription of many ISGs, whose protein products mediate specific IFN-dependent biologic responses. IFNs mediate a critical role in innate cellular defense against viral infection. The antiviral activity of INFs include inhibition of viral replication and protein synthesis and the induction of viral mRNA degradation. In addition to their antiviral activity, IFNs exhibit growth inhibitory activity, either by mediating cell death (through caspases) or by modulating the expression of proteins regulating cell cycle entry and exit, hence mediating growth arrest. IFNs are also involved in the regulation of immune response towards viral or tumor challenge; A well-characterized function of IFNs is their ability to upregulate MHC class I expression and consequently promote CD8+ T cell responses. Moreover, IFNs can regulate the expression of key cytokines that influence T cell responses, namely, IL-12, IL-15 and IFN-γ and of CC-chemokines. IFNs-α/β regulate the functions of immune cells from different lineages including NK cells, dentritic cells and B/T lymphocytes (Deonarain et al. 2002. Current Pharmaceutical Design. Vol. 8, No. 24, Pp. 2131-2137; Brierley et al. 2002. Journal of Interferon and Cytokine Research. 22:835-845).

Prior attempts to inhibit the interferon mediated activities included the use of mono clonal antibodies directed against the IFNAR-2 receptor. These receptors neutralized type I IFN-mediated antiviral, antiproliferative, and major histocompatibility complex (MHC) class I upregulation functions (Novick D, et al., 2000; J. Interferon Cytokine Res. 20: 971-82).

Clinical Application

Due to their growth inhibitory activity and the modulation of immune responses, type I interferons have been used as therapeutic polynucleotide or polypeptide sequences against a variety of solid tumors and hematological malignancies. IFN-α has been approved for the treatment of chronic myelogenous leukemia (CML), multiple myeloma, hairy cell leukemia and several lymphomas. Thus, IFN-α is the treatment of choice for CML patients which are not eligible for allogeneic bone marrow transplantation. In addition, the therapeutic efficacy of IFNs polynucleotide or polypeptide sequences in the treatment of viral infections and autoimmune diseases has been proved. Thus, IFN-α is the treatment of choice for hepatitis B and C infections and accumulating evidence supports the use of IFN-β for the treatment of multiple sclerosis.

In addition, since INR2 is overexpressed in lymph nodes-tumors it can be used as a marker for lymph node tumors.

Splice Variant HSIFNABR_T14 (Transcript) Encodes a Secreted Form of INR2 (HSIFNABR_P8)

The present inventors have uncovered a new INR2 variant [HSIFNABR_P8-SEQ ID NO:155 (FIG. 96b); HSIFNABR_T14—SEQ ID NO:156 (FIG. 96a)]. The protein coordinates on the transcript start from nucleotide 361 and end at nucleotide 951 as set forth in SEQ ID NO:156 (HSIFNABR_T14 transcript).

Alignment of the new INR2 variant (HSIFNABR_P8—SEQ ID NO:155) with the WT protein (GenBank Accession No. P48551; SEQ ID NO:157) revealed that the new variant includes the first 180 amino acids as of the WT protein (GenBank Accession No. P48551) followed by a unique 17 amino acid sequence RGEDEKLDISQFCHRQAL (SEQ ID NO:158), FIG. 97]. The new variant uncovered by the present invention lacks the Cytokine receptor class 2 (IPR000282)

and the transmembrane domain of the WT protein (amino acids 244-264 of GenBank Accession No. P48551) and therefore is expected to be a secreted or a soluble protein.

Comparison Report Between HSIFNABR_P8 and INR2_HUMAN

1. An isolated chimeric polypeptide HSIFNABR_P8, comprising a first amino acid sequence being at least 90% homologous to MLLSQNAFIPRSLNLVLMVYISLVFGI-SYDSPDYTDESCTFKISLRNFRSILSWE LKNH-SIVPTHYTLLYTIMSKPEDLKVVKN-CANTTRSFCDLTDEWRSTHEAYV TVLEGFSGNTTLFSCSHNFWLAIDMS-FEPPEFEIVGFTNHINVMVKFPSIVEEEL QFDLSLVIE-EQSEGIVKK corresponding to amino acids 1-180 of INR2_HUMAN (SEQ ID NO:157), which also corresponds to amino acids 1-180 of HSIFNABR_P8 (SEQ ID NO:155), and a second amino acid sequence being at least 70%, optionally at least 80%, preferably at least 85%, more preferably at least 90% and most preferably at least 95% homologous to a polypeptide having the sequence GEDEKLDISQFCHRQAL (SEQ ID NO:158) corresponding to amino acids 181-197 of HSIFNABR_P8 (SEQ ID NO:155), wherein said first amino acid sequence and second amino acid sequence are contiguous and in a sequential order.

2. An isolated polypeptide for a tail of HSIFNABR_P8 (SEQ ID NO:155), comprising a polypeptide being at least 70%, optionally at least about 80%, preferably at least about 85%, more preferably at least about 90% and most preferably at least about 95% homologous to the sequence GEDEKLD-ISQFCHRQAL (SEQ ID NO:158) in HSIFNABR_P8 (SEQ ID NO:155).

Thus, the present inventors uncovered a therapeutic agent which can be used to: (i) increase the in vivo stability of INF (e.g., IFN-α, IFN-β, IFN-ω, IFN-κ, and IFN-τ), (ii) increase INR2-mediated signaling by stabilizing the interaction between INF (e.g., IFN-α, IFN-β, IFN-ω, IFN-κ, and IFN-τ) and INR2, (iii) treat a disorder associated with INR2 signaling such as cancer (e.g., leukaemia, chronic myelogenous, hairy cell cancer, lymphoma, non-Hodgkin's lymphoma, melanoma, myeloma, renal cancer, bone cancer, sarcoma, Kaposi's sarcoma, brain cancer, cervical cancer, head and neck cancer, skin cancer), infection [e.g., HIV/AIDS infection, coronavirus infection, prophylaxis infection, general infection, hepatitis virus infection (such as hepatitis-B, hepatitis-C), herpes simplex virus, herpes virus, human papilloma virus, varicella zoster virus], multiple sclerosis, Pemphigus, Behcet's disease, chronic fatigue syndrome, hepatic cirrhosis, fibromyalgia, pulmonary fibrosis, inflammation (brain), Keratoconjunctivitis, and macular degeneration. Such an agent is a polypeptide homologous to the INR2 variant of the present invention (HSIFNABR_P8) (SEQ ID NO: 155), and/or a polynucleotide homologous to SEQ ID NO:156, and/or a peptide homologous to GEDEKLDISQFCHRQAL (SEQ ID NO:158). It will be appreciated that such an agent can be administered per se or as part of a pharmaceutical composition along with a suitable pharmaceutical acceptable carrier (e.g., PEG and liposomes).

Thus, the present invention provides therapeutic agents which can be used as anticancer, antifungal, antiviral, anti-HIV, anti-AIDS, immunostimulant, immunomodulator, hepatoprotective, antiinfective agents, as well as for the treatment of Multiple sclerosis, musculoskeletal, neurological, ophthalmological, respiratory and stomatological diseases.

While further reducing the present invention to practice, the present inventors have uncovered that the INR2 variant of the present invention i.e., HSIFNABR_P8 (SEQ ID NO:155), HSIFNABR_T14 (SEQ ID NO:156) or the peptide derived therefrom [GEDEKLDISQFCHRQAL (SEQ ID NO:158)] can be used as a diagnostic marker for various cancers such as lymph node tumors.

Example 10

Description for Cluster D12020

Cluster D12020 features 3 transcript(s) and 22 segment(s) of interest, the names for which are given in Tables 5 and 6, respectively, the sequences themselves are given in SEQ ID NOs: 341-343; 344-365 and 367-369, for transcripts; segments and proteins, respectively. The selected protein variants are given in Table 7.

TABLE 5

Transcripts of interest

| Transcript Name | SEQ ID NO |
|---|---|
| D12020_T23 | 341 |
| D12020_T31 | 342 |
| D12020_T35 | 343 |

TABLE 6

Segments of interest

| Segment Name | SEQ ID NO |
|---|---|
| D12020_node_2 | 344 |
| D12020_node_4 | 345 |
| D12020_node_12 | 346 |
| D12020_node_15 | 347 |
| D12020_node_26 | 348 |
| D12020_node_29 | 349 |
| D12020_node_30 | 350 |
| D12020_node_38 | 351 |
| D12020_node_42 | 352 |
| D12020_node_47 | 353 |
| D12020_node_49 | 354 |
| D12020_node_52 | 355 |
| D12020_node_53 | 356 |
| D12020_node_7 | 357 |
| D12020_node_16 | 358 |
| D12020_node_17 | 359 |
| D12020_node_21 | 360 |
| D12020_node_28 | 361 |
| D12020_node_32 | 362 |
| D12020_node_41 | 363 |
| D12020_node_50 | 364 |
| D12020_node_51 | 365 |

TABLE 7

Proteins of interest

| Protein Name | Protein Length | SEQ ID NO | Corresponding Transcript(s) |
|---|---|---|---|
| D12020_P5 | P279 | 367 | D12020_T23 |
| D12020_P10 | P225 | 368 | D12020_T31 |
| D12020_P11 | P130 | 369 | D12020_T35 |

These sequences are variants of the known protein Tissue factor pathway inhibitor precursor (SwissProt accession identifier TFPI_HUMAN; known also according to the synonyms TFPI; Lipoprotein-associated coagulation inhibitor; LACI; Extrinsic pathway inhibitor; EPI) (SEQ ID NO:366), referred to herein as the previously known protein.

Protein Tissue factor pathway inhibitor precursor is known or believed to have the following function(s): Inhibits factor X (X(a)) directly and, in a Xa-dependent way, inhibits VIIa/tissue factor activity, presumably by forming a quaternary Xa/LACI/VIIa/TF complex. It possesses an antithrombotic action and also the ability to associate with lipoproteins in plasma. Tissue factor pathway inhibitor precursor is ("Tissue factor pathway inhibitor precursor amino acid sequence") is set forth by SEQ ID NO:366. Known polymorphisms for this sequence are as shown in Table 8.

TABLE 8

Amino acid mutations for Known Protein

SNP position(s) on
amino acid sequence  Comment

| | |
|---|---|
| 292 | V → M (in dbSNP: 5940)./FTId = VAR_012004. |
| 64 | K → I: ABOLISHES INHIBITION OF VII(A)/TF. |
| 135 | R → L: ABOLISHES INHIBITION OF X(A). |
| 227 | R → L: ABOLISHES INHIBITION OF VII(A)/TF. |

Protein Tissue factor pathway inhibitor precursor localization is believed to be secreted.

The previously known protein also has the following indication(s) and/or potential therapeutic use(s): haemorrhage; oedema; inflammation, pulmonary; sepsis; thrombosis; cancer. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: angiogenesis inhibitor; elastase inhibitor; factor Xa inhibitor; kallikrein antagonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticancer; Anticoagulant; Antithrombotic; Septic shock treatment; Cardiovascular; Anti-inflammatory; Haemostatic.

The following GO Annotation(s) apply to the previously known protein. The following annotation(s) were found: blood coagulation, which are annotation(s) related to Biological Process; proteinase inhibitor; serine protease inhibitor, which are annotation(s) related to Molecular Function; and extracellular, which are annotation(s) related to Cellular Component.

The GO assignment relies on information from one or more of the SwissProt/TremB1 Protein knowledgebase, or Locuslink.

Tissue Factor Pathway Inhibitor (TFPI) is a serine protease inhibitor which inhibits factor X (X(a)) directly and, in a Xa-dependent way, inhibits VIIa/tissue factor activity, presumably by forming a quaternary Xa/LACI/VIIa/TF complex. It is anti-thrombotic and it also inhibits the extrinsic pathway complex: TF/F7/F10.

As noted above, cluster D12020 features 3 transcript(s), which were listed in Table 1 above. These transcript(s) encode for protein(s) which are variant(s) of protein Tissue factor pathway inhibitor precursor. A description of each variant protein according to the present invention is now provided.

Variant protein D12020_P5 (SEQ ID NO:367) according to the present invention is encoded by transcript(s) D12020_T23 (SEQ ID NO:341). An alignment is given to the known protein (Tissue factor pathway inhibitor precursor; SEQ ID NO:366) in FIG. 145. One or more alignments to one or more previously published protein sequences are given in FIGS. 146-147. A brief description of the relationship of the variant protein according to the present invention to each such aligned protein is as follows:

Comparison Report Between D12020_P5 (SEQ ID NO:367) and TFPI_HUMAN(SEQ ID NO:366):

1. An isolated chimeric polypeptide D12020_P5 (SEQ ID NO:367), comprising a first amino acid sequence being at least 70%, optionally at least 80%, preferably at least 85%, more preferably at least 90% and most preferably at least 95% homologous to a polypeptide having the sequence MHFGLLYACCLILPLPLLMLILRKMKNTQLSQ corresponding to amino acids 1-32 of D12020_P5 (SEQ ID NO:367), and a second amino acid sequence being at least 90% homologous to ADDGPCKAIMKRFFFNIFTRQCEEFIYGGCEGNQNRFESLEECKKMCTRDNAN RIIKTTLQQEKPDFCFLEEDPGICRGYITRYFYNNQTKQCERFKYGGCLGNMN NFETLEECKNICEDGPNGFQVDNYGTQLNAVNNSLTPQSTKVPSLFEFHGPSW CLTPADRGLCRANENRFYYNSVIGKCRPFKYSGCGGNENNFTSKQECLRACK KGFIQRISKGGLIKTKRKRKKQRVKIAYEEIFVKNM corresponding to amino acids 58-304 of TFPI_HUMAN (SEQ ID NO:366), which also corresponds to amino acids 33-279 of D12020_P5 (SEQ ID NO:367), wherein said first amino acid sequence and second amino acid sequence are contiguous and in a sequential order.

2. An isolated polypeptide for a head of D12020_P5 (SEQ ID NO:367), comprising a polypeptide being at least 70%, optionally at least about 80%, preferably at least about 85%, more preferably at least about 90% and most preferably at least about 95% homologous to the sequence MHFGLLYACCLILPLPLLMLILRKMKNTQLSQ of D12020_P5.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein D12020_P5 (SEQ ID NO:367) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein D12020_P5 sequence provides support for the deduced sequence of this variant protein according to the present invention).

TABLE 9

| Amino acid mutations | | |
|---|---|---|
| SNP position(s) on amino acid sequence | Alternative amino acid(s) | Previously known SNP? |
| 116 | Y → | No |
| 122 | T → | No |
| 136 | N → | No |
| 144 | E → | No |
| 267 | V → M | Yes |

The glycosylation sites of variant protein D12020_P5 (SEQ ID NO:367), as compared to the known protein Tissue factor pathway inhibitor precursor, are described in Table 10

(given according to their position(s) on the amino acid sequence in the first column; the second column indicates whether the glycosylation site is present in the variant protein; and the last column indicates whether the position is different on the variant protein).

TABLE 10

Glycosylation site(s)

| Position(s) on known amino acid sequence | Present in variant protein? | Position in variant protein? |
|---|---|---|
| 202 | yes | 177 |
| 203 | yes | 178 |
| 145 | yes | 120 |
| 195 | yes | 170 |

The variant protein has the following domains, as determined by using InterPro. The domains are described in Table 11:

TABLE 11

InterPro domain(s)

| InterPro ID | Domain description | Analysis type | Position(s) on protein |
|---|---|---|---|
| IPR002223 | Pancreatic trypsin inhibitor (Kunitz) | FPrintScan | 125-135, 227-242, 97-111 |
| IPR008296 | Tissue factor pathway inhibitor | HMMPIR | 1-279 |
| IPR002223 | Pancreatic trypsin inhibitor (Kunitz) | HMMPfam | 100-150, 192-242, 30-79 |
| IPR002223 | Pancreatic trypsin inhibitor (Kunitz) | HMMSmart | 190-243, 27-80, 98-151 |
| IPR002223 | Pancreatic trypsin inhibitor (Kunitz) | ScanRegExp | 128-146, 220-238, 57-75 |
| IPR002223 | Pancreatic trypsin inhibitor (Kunitz) | BlastProDom | 107-150, 199-242, 36-82 |
| IPR002223 | Pancreatic trypsin inhibitor (Kunitz) | ProfileScan | 100-150, 192-242, 34-79 |

Variant protein D12020_P5 (SEQ ID NO:367) is encoded by the following transcript(s): D12020_T23 (SEQ ID NO:341). The coding portion of transcript D12020_T23 (SEQ ID NO:341) starts at position 274 and ends at position 1110. The transcript also has the following SNPs as listed in Table 12 (given according to their position on the nucleotide sequence, with the alternative nucleic acid listed; the last column indicates whether the SNP is known or not; the presence of known SNPs in variant protein D12020_P5 (SEQ ID NO:367) sequence provides support for the deduced sequence of this variant protein according to the present invention).

TABLE 12

Nucleic acid SNPs

| SNP position on nucleotide sequence | Alternative nucleic acid | Previously known SNP? |
|---|---|---|
| 450 | T → C | Yes |
| 621 | T → | No |
| 639 | A → | No |
| 639 | A → C | No |
| 679 | A → | No |
| 704 | A → | No |
| 1072 | G → A | Yes |
| 1255 | G → A | Yes |
| 1592 | T → A | Yes |

TABLE 12-continued

Nucleic acid SNPs

| SNP position on nucleotide sequence | Alternative nucleic acid | Previously known SNP? |
|---|---|---|
| 2381 | C → T | Yes |
| 2465 | T → | No |
| 2482 | G → A | Yes |
| 2587 | G → A | Yes |
| 2639 | A → T | Yes |
| 2766 | A → G | Yes |
| 2870 | G → A | Yes |
| 3197 | T → C | No |
| 3430 | G → A | Yes |
| 3807 | C → T | No |

Variant protein D12020_P10 (SEQ ID NO:368) according to the present invention is encoded by transcript(s) D12020_T31 (SEQ ID NO:342). An alignment is given to the known protein (Tissue factor pathway inhibitor precursor), in FIG. 146. A brief description of the relationship of the variant protein according to the present invention to each such aligned protein is as follows:

Comparison Report Between D12020_P10 (SEQ ID NO:368) and TFPI_HUMAN (SEQ ID NO:366):

1. An isolated chimeric polypeptide D12020_P10 (SEQ ID NO:368), comprising a first amino acid sequence being at least 90% homologous to MIYTMKKVHALWASVCLLLN-LAPAPLNADSEEDEEHTIITDTELPPLKLMHSF CAF-KADDGPCKAIMKREFFNIFTRQCEEF-IYGGCEGNQNREESLEECKKMCTR DNANRIIKTTLQQEKPDFCFLEEDPGI-CRGYITRYFYNNQTKQCERFKYGGCL GNMNN-FETLEECKNICEDGPNGFQVDNYGTQL-NAVNNSLTPQSTKVPSLF corresponding to amino acids 1-209 of TFPI_HUMAN (SEQ ID NO:366), which also corresponds to amino acids 1-209 of D12020_P10 (SEQ ID NO:368), and a second amino acid sequence being at least 70%, optionally at least 80%, preferably at least 85%, more preferably at least 90% and most preferably at least 95% homologous to a polypeptide having the sequence GKNLVD-FIASRKLLSC corresponding to amino acids 210-225 of D12020_P10 (SEQ ID NO:368), wherein said first amino acid sequence and second amino acid sequence are contiguous and in a sequential order.

2. An isolated polypeptide for a tail of D12020_P10 (SEQ ID NO:368), comprising a polypeptide being at least 70%, optionally at least about 80%, preferably at least about 85%, more preferably at least about 90% and most preferably at least about 95% homologous to the sequence GKNLVDFI-ASRKLLSC in D12020_P10.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein D12020_P10 (SEQ ID NO:368) also has the following non-silent SNPs (Single Nucleotide Polymorphisms) as listed in Table 13, (given according to their position(s) on the amino acid sequence, with the alternative amino acid(s) listed; the last column indicates whether the SNP is known or not; the presence of known SNPs in variant protein D12020_P10 (SEQ ID NO:368) sequence provides support for the deduced sequence of this variant protein according to the present invention).

TABLE 13

Amino acid mutations

| SNP position(s) on amino acid sequence | Alternative amino acid(s) | Previously known SNP? |
|---|---|---|
| 53 | → | No |
| 141 | → | No |
| 147 | → | No |
| 161 | → | No |
| 169 | → | No |

The glycosylation sites of variant protein D12020_P10 (SEQ ID NO:368), as compared to the known protein Tissue factor pathway inhibitor precursor, are described in Table 14 (given according to their position(s) on the amino acid sequence in the first column; the second column indicates whether the glycosylation site is present in the variant protein; and the last column indicates whether the position is different on the variant protein).

TABLE 14

Glycosylation site(s)

| Position(s) on known amino acid sequence | Present in variant protein? | Position in variant protein? |
|---|---|---|
| 202 | yes | 202 |
| 203 | yes | 203 |
| 145 | yes | 145 |
| 195 | yes | 195 |

The variant protein has the following domains, as determined by using InterPro. The domains are described in Table 15:

TABLE 15

InterPro domain(s)

| InterPro ID | Domain description | Analysis type | Position(s) on protein |
|---|---|---|---|
| IPR002223 | Pancreatic trypsin inhibitor (Kunitz) | FPrintScan | 51-65, 79-89, 89-104 |
| IPR002223 | Pancreatic trypsin inhibitor (Kunitz) | HMMPfam | 125-175, 54-104 |
| IPR002223 | Pancreatic trypsin inhibitor (Kunitz) | HMMSmart | 123-176, 52-105 |
| IPR002223 | Pancreatic trypsin inhibitor (Kunitz) | ScanRegExp | 153-171, 82-100 |
| IPR002223 | Pancreatic trypsin inhibitor (Kunitz) | BlastProDom | 132-175, 61-107 |
| IPR002223 | Pancreatic trypsin inhibitor (Kunitz) | ProfileScan | 125-175, 54-104 |

Variant protein D12020_P10 (SEQ ID NO:368) is encoded by the following transcript(s): D12020_T31 (SEQ ID NO:342). The coding portion of transcript D12020_T31 starts at position 330 and ends at position 1004. The transcript also has the following SNPs as listed in Table 16 (given according to their position on the nucleotide sequence, with the alternative nucleic acid listed; the last column indicates whether the SNP is known or not; the presence of known SNPs in variant protein D12020_P10 sequence provides support for the deduced sequence of this variant protein according to the present invention).

TABLE 16

Nucleic acid SNPs

| SNP position on nucleotide sequence | Alternative nucleic acid | Previously known SNP? |
|---|---|---|
| 284 | T → | No |
| 486 | T → | No |
| 581 | T → C | Yes |
| 752 | T → | No |
| 770 | A → | No |
| 770 | A → C | No |
| 810 | A → | No |
| 835 | A → | No |
| 965 | T → C | Yes |
| 1138 | A → C | Yes |
| 1196 | T → C | Yes |
| 1226 | T → A | Yes |

Variant protein D12020_P11 (SEQ ID NO:369) according to the present invention is encoded by transcript(s) D12020_T35 (SEQ ID NO:343). An alignment is given to the known protein (Tissue factor pathway inhibitor precursor) in 147. A brief description of the relationship of the variant protein according to the present invention to each such aligned protein is as follows:

Comparison Report Between D12020_P11 (SEQ ID NO:369) and TFPI_HUMAN (SEQ ID NO:366):

1. An isolated chimeric polypeptide D12020_P11 (SEQ ID NO:369), comprising a first amino acid sequence being at least 90% homologous to MIYTMKKVHALWASVCLLLN-LAPAPLNADSEEDEEHTIITDTELPPLKLMHSF CAF-KADDGPCKAIMKRFFFNIFTRQCEEF-IYGGCEGNQNREESLEECKKMCTR corresponding to amino acids 1-106 of TFPI_HUMAN (SEQ ID NO:366), which also corresponds to amino acids 1-106 of D12020_P11 (SEQ ID NO:369), and a second amino acid sequence being at least 70%, optionally at least 80%, preferably at least 85%, more preferably at least 90% and most preferably at least 95% homologous to a polypeptide having the sequence GRFLGTLITQDPLGLLSLIMDLII corresponding to amino acids 107-130 of D12020_P11 (SEQ ID NO:369), wherein said first amino acid sequence and second amino acid sequence are contiguous and in a sequential order.

2. An isolated polypeptide for a tail of D12020_P11 (SEQ ID NO:369), comprising a polypeptide being at least 70%, optionally at least about 80%, preferably at least about 85%, more preferably at least about 90% and most preferably at least about 95% homologous to the sequence GRFLGTL-ITQDPLGLLSLIMDLII in D12020_P11 (SEQ ID NO:369).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein D12020_P11 (SEQ ID NO:369) also has the following non-silent SNPs (Single Nucleotide Polymorphisms) as listed in Table 17, (given according to their position(s) on the amino acid sequence, with the alternative amino acid(s) listed; the last column indicates whether the SNP is known or not; the presence of known SNPs in variant protein D12020_P11 (SEQ ID NO:369) sequence provides support for the deduced sequence of this variant protein according to the present invention).

TABLE 17

Amino acid mutations

| SNP position(s) on amino acid sequence | Alternative amino acid(s) | Previously known SNP? |
|---|---|---|
| 53 | F → | No |
| 110 | L → P | Yes |

The glycosylation sites of variant protein D12020_P11 (SEQ ID NO:369), as compared to the known protein Tissue factor pathway inhibitor precursor, are described in Table 18 (given according to their position(s) on the amino acid sequence in the first column; the second column indicates whether the glycosylation site is present in the variant protein; and the last column indicates whether the position is different on the variant protein).

TABLE 18

Glycosylation site(s)

| Position(s) on known amino acid sequence | Present in variant protein? | Position in variant protein? |
|---|---|---|
| 202 | no | |
| 203 | no | |
| 145 | no | |
| 195 | no | |

The variant protein has the following domains, as determined by using InterPro. The domains are described in Table 19:

TABLE 19

InterPro domain(s)

| InterPro ID | Domain description | Analysis type | Position(s) on protein |
|---|---|---|---|
| IPR002223 | Pancreatic trypsin inhibitor (Kunitz) | FPrintScan | 51-65, 79-89, 89-104 |
| IPR002223 | Pancreatic trypsin inhibitor (Kunitz) | HMMPfam | 54-104 |
| IPR002223 | Pancreatic trypsin inhibitor (Kunitz) | HMMSmart | 52-105 |
| IPR002223 | Pancreatic trypsin inhibitor (Kunitz) | ScanRegExp | 82-100 |
| IPR002223 | Pancreatic trypsin inhibitor (Kunitz) | BlastProDom | 61-106 |
| IPR002223 | Pancreatic trypsin inhibitor (Kunitz) | ProfileScan | 54-104 |

Variant protein D12020_P11 (SEQ ID NO:369) is encoded by the following transcript(s): D12020_T35 (SEQ ID NO:343). The coding portion of transcript D12020_T35 (SEQ ID NO:343) starts at position 615 and ends at position 1004. The transcript also has the following SNPs as listed in Table 20 (given according to their position on the nucleotide sequence, with the alternative nucleic acid listed; the last column indicates whether the SNP is known or not; the presence of known SNPs in variant protein D12020_P11 (SEQ ID NO:369) sequence provides support for the deduced sequence of this variant protein according to the present invention).

TABLE 20

Nucleic acid SNPs

| SNP position on nucleotide sequence | Alternative nucleic acid | Previously known SNP? |
|---|---|---|
| 284 | T → | No |
| 771 | T → | No |
| 866 | T → C | Yes |
| 943 | T → C | Yes |
| 1084 | C → G | Yes |

Figure 33:
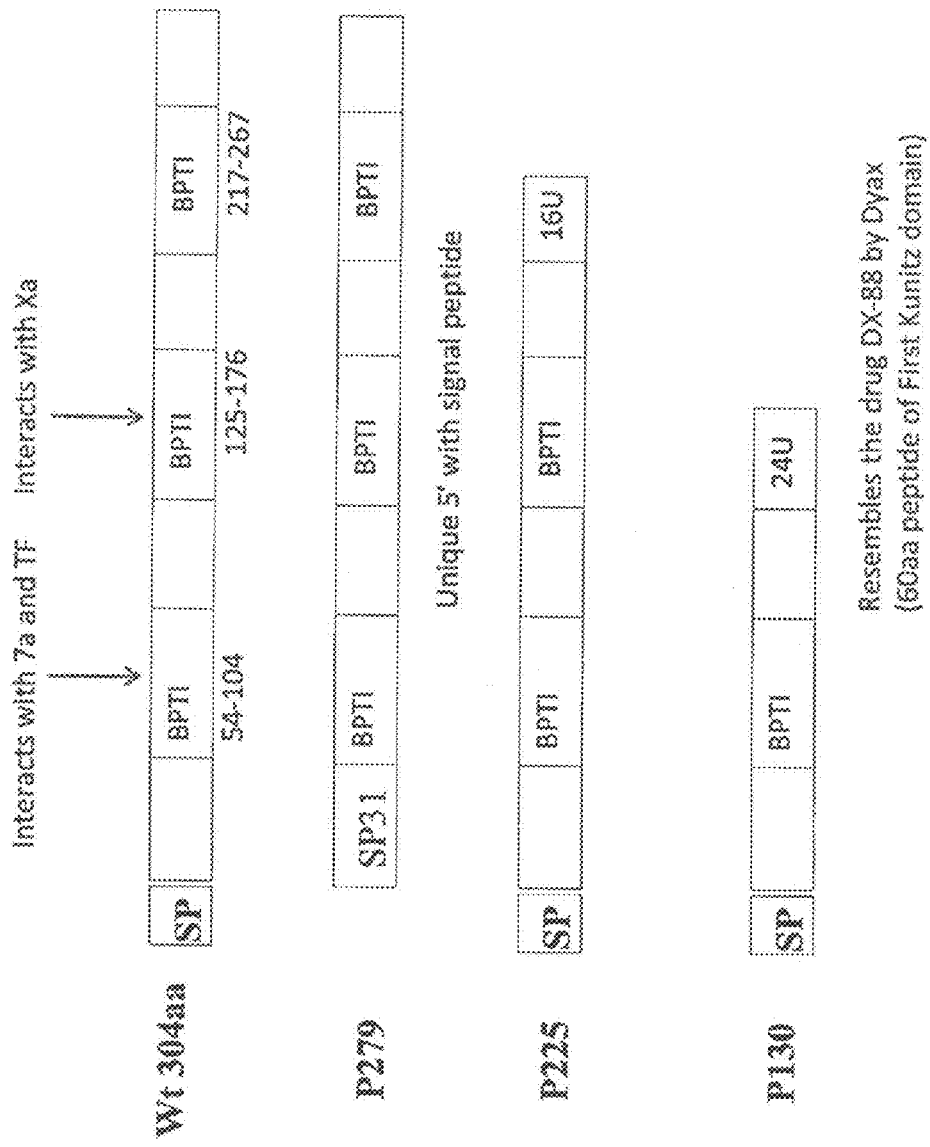
FIG. 33 summarizes the domain structures of the variants described in Example 10.

FIG. 33 summarizes the domain structures of the above variants.

Example 11

Splice Variant of Tumor Necrosis Factor Receptor Superfamily Member 14

Background

The tumor necrosis factor receptor superfamily member 14 (TR14_HUMAN; GenBank Accession No. Q92956; SEQ ID NO:161; Type I membrane protein; Herpesvirus entry mediator A; Tumor necrosis factor receptor-like 2; TR2; The HUGO gene symbol of this product: HVEA; HVEM; TNFRSF14) is a cellular receptor for TNF superfamily 14 (LIGHT) which involves in immune response, cell surface receptor linked signal transduction and apoptosis. TR14 is overexpressed in skin and can be used as a marker for proliferation of this tissue or as a marker for pathological de-differentiation of this tissue or tissue damage. In addition, since TR14 is overexpressed in skin and pancreas tumors it can be used as a marker for these pathologies.

Splice Variant Z42185_T13 (SEQ ID NO:159) Encodes a New Secreted form of the TR14 Receptor, Z42185_P5 (SEQ ID NO:160)

The present inventors have uncovered a new TR14 variant V42185_P5—SEQ ID NO:160 (FIG. 98b); Z42185_T13—SEQ ID NO:159 (FIG. 98a)]. The protein coordinates on the transcript start from nucleotide 891 and end at nucleotide 1481 as set forth in SEQ ID NO:159 (Z42185_T13 transcript).

Alignment of the new TR14 variant (Z42185_P5—SEQ ID NO:160) with the WT protein (GenBank Accession No. Q92956; SEQ ID NO:161) revealed that the new variant includes the first 183 amino acids as of the WT protein (GenBank Accession No. Q92956) followed by a unique 14 amino acid sequence [(NWPNHMCEKKKAKG (SEQ ID NO:162), FIG. 99]. The new variant uncovered by the present invention lacks the transmembrane domain of the WT protein (amino acids 203-223 of GenBank Accession No. Q92956) and therefore is expected to be a secreted, soluble protein (i.e., extracellular).

Comparison Report Between Z42185_P5 (SEQ ID NO:160) and TR14_HUMAN (SEQ ID NO:161)

1. An isolated chimeric polypeptide Z42185_P5 (SEQ ID NO:160), comprising a first amino acid sequence being at least 90% homologous to MEPPGDWGPPPWRSTPKTDV-LRLVLYLTFLGAPCYAPALPSCKEDEYPVGSE CCPKC-SPGYRVKEACGELTGTVCEPCPPGTYI-AHLNGLSKCLQCQMCDPAMG LRASRNCSRTENAVCGCSPGHF-CIVQDGDHCAACRAYATSSPGQRVQKGGTE SQDTL-CQNCPPGTFSPNGTLEECQHQT corresponding to amino acids 1-183 of TR14_HUMAN (SEQ ID NO:161), which also corresponds to amino acids 1-183 of Z42185_P5 (SEQ ID NO:160), and a second amino acid sequence being at least 70%, optionally at least 80%, preferably at least 85%, more preferably at least 90% and most preferably at least 95% homologous to a polypeptide having the sequence NWPNHMCEKKKAKG (SEQ ID NO:162) corresponding to amino acids 184-197 of Z42185_P5 (SEQ ID NO:160), wherein said first amino acid sequence and second amino acid sequence are contiguous and in a sequential order.

2. An isolated polypeptide for a tail of Z42185_P5 (SEQ ID NO:160), comprising a polypeptide being at least 70%, optionally at least about 80%, preferably at least about 85%, more preferably at least about 90% and most preferably at least about 95% homologous to the sequence NWPNHMCEKKKAKG (SEQ ID NO:162) in Z42185_P5 (SEQ ID NO:160).

These results suggest the use of the new TR14 variant of the present invention (Z42185_P5—SEQ ID NO:160), the polynucleotide encoding same (Z42185_T13—SEQ ID NO:159) and/or the peptide derived from the Z42185_P5 TR14 variant (NWPNHMCEKKKAKG—SEQ ID NO:162) as a diagnostic marker for skin proliferation or de-differentiation, as well as skin and pancreas tumors. Diagnosis according to this aspect of the present invention is effected using immunological assays [e.g., Western Blot, immunohistochemistry, FACS analysis, radio immuno assay (RIA), immunofluorescence, and the like using an antibody directed against the TR14 variant (Z42185_P5—SEQ ID NO:160)], nucleic acid techniques (NAT) such as RT-PCR, Northern Blot, in situ hybridization, in situ RT-PCR.

Example 12

Splice Variant of Integrin Beta-2 Precursor

Background

The β2 integrin receptors (e.g., LFA-1, Mac-1, and p150, 95) are expressed on leukocytes and play a major role in leukocyte cell-cell and cell-matrix adhesions during inflammation and other immune responses.

The integrin beta-2 precursor (Cell surface adhesion glycoproteins LFA-1/CR3/p150,95 beta-subunit; CD18; Complement receptor C3 beta-subunit; GenBank Accession No. P05107; ITB2_HUMAN; ITGB2) associates with an integrin α subunit (α-L, α-M, α-X, α-D) to form a Type I membrane protein receptor. Thus, integrin α-L/β-2 is a receptor for ICAM1, ICAM2, ICAM3 and ICAM4; integrins α-M/β-2 and α-X/β-2 are receptors for the iC3b fragment of the third complement component and for fibrinogen; integrin α-M/β-2 is also a receptor for factor X; integrin α-D/β-2 is a receptor for ICAM3 and VCAM1. The integrin receptors recognize specific ligands via recognition sequences such as the G-P—R in fibrinogen alpha-chain which is recognized by integrin α-X/β-2 and the P1 and P2 peptides of fibrinogen gamma chain which is recognized by integrin α-M/β-2.

Defects in ITGB2 are the cause of leukocyte adhesion deficiency type I (LAD1) [MIM:116920]. LAD1 patients have recurrent bacterial infections and their leukocytes are deficient in a wide range of adhesion-dependent functions. The integrin β-2 precursor protein contains one VWFA-like domain.

Clinical Applications

Since β2 integrin receptors are expressed on leukocytes and are involved in various cell-cell and cell-matrix adhesions during inflammation and other immune responses, inhibition of β2 integrins or the introducing of soluble forms of β2 integrins can be used as anti-inflammatory agents for the treatment of various diseases including cancers (e.g., breast cancer), coronary artery bypass grafting, haemorrhage, myocardial infarction, inflammation (e.g., pulmonary inflammation), cerebral ischaemia, osteoporosis, reperfusion injury, transplant rejection (e.g., bone marrow transplant rejection) and hepatic dysfunction.

For example, prior studies have shown that murine monoclonal antibodies directed against the CD11b/CD18 (CR3) heterodimer are capable of reducing the phagocyte-mediated ischemia-reperfusion injury in several organ systems, such as the myocardium, liver, and gastrointestinal tract, as well as inhibiting the development of insulin-dependent diabetes mellitus in nonobese diabetic (NOD) mice (Dana N, et al., 1991; Proc. Natl. Acad. Sci. USA, 88: 3106-10).

Splice Variant HUMLAP_T18 (SEQ ID NO:163) Encodes a New Secreted Form of Integrin β2, HUMLAP_P15 (SEQ ID NO:164)

The present inventors have uncovered a new integrin β2 variant [HUMLAP_P15—SEQ ID NO:164 (FIG. 100b); HUMLAP_T18 SEQ ID NO:163 (FIG. 100a)]. The protein coordinates on the transcript start from nucleotide 414 and end at nucleotide 737 as set forth in SEQ ID NO:163 (HUMLAP_T18 transcript).

Alignment of the new integrin β2 variant (HUMLAP_P15—SEQ ID NO:164) with the WT protein (GenBank Accession No. P05107; SEQ ID NO:165) revealed that the new variant includes the first 49 amino acids as of the WT protein (GenBank Accession No. P05107) followed by a unique 59 amino acid sequence [G AALGPPAHATAASSPRRRSRVAPVCPRTEQG-GQAPGGNYLGQAGFFPSPFWR FSAPLK (SEQ ID NO:166), FIG. 101]. The new variant uncovered by the present invention lacks the majority of the ITGB2 mature sequence (IPR002369 Integrin, beta chain IPR003659 Plexin/semaphorin/integrin) including potential sites of glycosylation and the transmembrane domain of the WT protein (amino acids 701-723 of GenBank Accession No. P05107) and therefore is expected to be a secreted, soluble and extracellular protein.

Comparison Report Between HUMLAP_P15 and ITB2_HUMAN

1. An isolated chimeric polypeptide HUMLAP_P15, comprising a first amino acid sequence being at least 90% homologous to MLGLRPPLLALVGLLSLGCVLSQECTKFKVSSCRECIESGPGCTWCQKL corresponding to amino acids 1-49 of ITB2_HUMAN (SEQ ID NO:165), which also corresponds to amino acids 1-49 of HUMLAP_P15 (SEQ ID NO:164), and a second amino acid sequence being at least 70%, optionally at least 80%, preferably at least 85%, more preferably at least 90% and most preferably at least 95% homologous to a polypeptide having the sequence GAALGPPAHATAASSPRRRSRVAPVCPRTEQG-GQAPGGNYLGQAGFFPSPFW RFSAPLK (SEQ ID NO:166) corresponding to amino acids 50-108 of HUMLAP_P15 (SEQ ID NO:164), wherein said first amino acid sequence and second amino acid sequence are contiguous and in a sequential order.

2. An isolated polypeptide for a tail of HUMLAP_P15 (SEQ ID NO:164), comprising a polypeptide being at least 70%, optionally at least about 80%, preferably at least about 85%, more preferably at least about 90% and most preferably at least about 95% homologous to the sequence GAALGPPAHATAASSPRRRSRVAPVCPRTEQG-GQAPGGNYLGQAGFFPSPFW RFSAPLK (SEQ ID NO:166) in HUMLAP_P15 (SEQ ID NO:164).

Clinical Applications of Using the Integrin β2 Variant of the Present Invention

Since the integrin variant of the present invention, HUMLAP_P15 (SEQ ID NO:164), is a soluble extracellular protein it can be used as an integrin β2 antagonist and/or an anti-inflammatory agent in the treatment of various diseases.

Thus, the present inventors uncovered a therapeutic agent which can be used to treat an integrin β2-related disease or condition [e.g., various cancers such as breast cancer, cardiovascular disease, coronary artery bypass grafting, haemorrhage, myocardial infraction, inflammation (e.g., pulmonary inflammation, asthma, GI inflammation, bowel disorder), cerebral ischaemia, osteoporosis, reperfusion injury, transplant rejection (e.g., bone marrow transplant rejection), psoriasis, osteoporosis treatment, respiratory disease, and hepatic dysfunction. Such an agent is a polypeptide homologous to the integrin β2 variant of the present invention (SEQ ID NO:164), and/or a polynucleotide homologous to SEQ ID NO:163, and/or a peptide homologous to SEQ ID NO:166. It will be appreciated that the polypeptide, polynucleotide and/or peptide used according to this aspect of the present can be administered or provided per se, or as part of a pharmaceutical composition with a pharmaceutical acceptable carrier (e.g., PEG and liposomes).

While further reducing the present invention to practice, the present inventors have uncovered that the integrin β2 variant of the present invention HUMLAP_P15 (SEQ ID NO:164), the peptide derived therefrom (SEQ ID NO:166) and/or the polynucleotide encoding same (SEQ ID NO:163), each and in any combination, can be used as diagnostic markers for various cancers including leukemia (blood malignancies) and muscle tumors. Diagnosis according to this aspect of the present invention is effected using immunological assays [e.g., Western Blot, immunohistochemistry, FACS analysis, radio immuno assay (RIA), immunofluorescence, and the like using an antibody directed against the integrin β2 variant (SEQ ID NO:164), or by nucleic acid techniques (NAT) such as RT-PCR, Northern Blot, in situ hybridization, in situ RT-PCR.

Example 13

Splice Variant of Integrin Beta-2 Precursor

Background

The β2 integrin receptors (e.g., LFA-1, Mac-1, and p150, 95) are expressed on leukocytes and play a major role in leukocyte cell-cell and cell-matrix adhesions during inflammation and other immune responses.

The integrin beta-2 precursor (Cell surface adhesion glycoproteins LFA-1/CR3/p150,95 beta-subunit; CD18; Complement receptor C3 beta-subunit; GenBank Accession No. P05107; ITB2_HUMAN; ITGB2) associates with an integrin α subunit (α-L, α-M, α-X, α-D) to form a Type I membrane protein receptor. Thus, integrin α-L/β-2 is a receptor for ICAM1, ICAM2, ICAM3 and ICAM4; integrins α-M/β-2 and α-X/β-2 are receptors for the iC3b fragment of the third complement component and for fibrinogen; integrin α-M/β-2 is also a receptor for factor X; integrin α-D/β-2 is a receptor for ICAM3 and VCAM1. The integrin receptors recognize specific ligands via recognition sequences such as the G-P—R in fibrinogen alpha-chain which is recognized by integrin α-X/β-2 and the P1 and P2 peptides of fibrinogen gamma chain which is recognized by integrin α-M/β-2.

Defects in ITGB2 are the cause of leukocyte adhesion deficiency type I (LAD1) [MIM:116920]. LAD1 patients have recurrent bacterial infections and their leukocytes are deficient in a wide range of adhesion-dependent functions. The integrin β-2 precursor protein contains one VWFA-like domain.

Clinical Applications

Since β2 integrin receptors are expressed on leukocytes and are involved in various cell-cell and cell-matrix adhesions during inflammation and other immune responses, inhibition of β2 integrins or the introducing of soluble forms of β2 integrins can be used as anti-inflammatory agents for the treatment of various diseases including cancers (e.g., breast cancer), coronary artery bypass grafting, haemorrhage, myocardial infarction, inflammation (e.g., pulmonary inflammation), cerebral ischaemia, osteoporosis, reperfusion injury, transplant rejection (e.g., bone marrow transplant rejection) and hepatic dysfunction.

For example, prior studies have shown that murine monoclonal antibodies directed against the CD11b/CD18 (CR3) heterodimer are capable of reducing the phagocyte-mediated ischemia-reperfusion injury in several organ systems, such as the myocardium, liver, and gastrointestinal tract, as well as inhibiting the development of insulin-dependent diabetes mellitus in nonobese diabetic (NOD) mice (Dana N, et al., 1991; Proc. Natl. Acad. Sci. USA, 88: 3106-10).

Splice Variant HUMLAP_T14 (SEQ ID NO:167) Encodes a New Secreted Form of Integrin β2, HUMLAP_P12 (SEQ ID NO:168)

The present inventors have uncovered a new integrin β2 variant [HUMLAP_P12 (SEQ ID NO:168); HUMLAP_T14 (SEQ ID NO:167)]. The protein coordinates on the transcript start from nucleotide 414 and end at nucleotide 1229 as set forth in SEQ ID NO:167 (HUMLAP_T14 transcript).

Alignment of the new integrin β2 variant (HUMLAP_P12—SEQ ID NO:168) with the WT protein (GenBank Accession No. P05107; SEQ ID NO:165) revealed that the new variant includes the first 217 amino acids as of the WT protein (GenBank Accession No. P05107) followed by a unique 55 amino acid sequence [SALKMTAMAGRVLLGARRGDSSTLTGTVFAWRLEEGGLEVGEVRCVFPVQ VRTSV (SEQ ID NO:169), FIG. 102]. The new variant uncovered by the present invention lacks the majority of the ITGB2 mature sequence (IPR002369 Integrin, beta chain), exhibits a truncated VWFA-like domain (amino acids 124-363 of GenBank Accession No. P05107) and lacks the transmembrane domain of the WT protein (amino acids 701-723 of GenBank Accession No. P05107) and therefore is expected to be a secreted, soluble and extracellular protein.

Comparison Report Between HUMLAP_P12 and ITB2_HUMAN

1. An isolated chimeric polypeptide HUMLAP_P12, comprising a first amino acid sequence being at least 90% homologous to MLGLRPPLLALVGLLSLGCVLSQECTKFKVSSCRECIESGPGCTWCQKLNFTG PGDPDSIRCDTRPQLLMRGCAADDIMDPTSLA-ETQEDHNGGQKQLSPQKVTL YLRPGQAAAFNVTFRRAKGYPIDLYYLM-DLSYSMLDDLRNVKKLGGDLLRA LNEITESGRIG-FGSFVDKTVLPFVNTHPDKLRNPCP-NKEKECQPPFAFRHVLKL TNNSNQF corresponding to amino acids 1-217 of ITB2_HUMAN (SEQ ID NO:165), which also corresponds to amino acids 1-217 of HUMLAP_P12 (SEQ ID NO:168), and a second amino acid sequence being at least 70%, optionally at least 80%, preferably at least 85%, more preferably at least 90% and most preferably at least 90% homologous to a polypeptide having the sequence SALKMTAMAGRVLLGARRGDSSTLTGTVFAWRLEEGGLEVGEVRCVFPVQV RTSV (SEQ ID NO:169) corresponding to amino acids 218-272 of HUM- LAP_P12 (SEQ ID NO:168), wherein said first amino acid sequence and second amino acid sequence are contiguous and in a sequential order.

2. An isolated polypeptide for a tail of HUMLAP_P12 (SEQ ID NO:168), comprising a polypeptide being at least 70%, optionally at least about 80%, preferably at least about 85%, more preferably at least about 90% and most preferably at least about 95% homologous to the sequence SALKMTAMAGRVLLGARRGDSSTLTGTVFAWRLEEGGLEVGEVRCVFPVQV RTSV (SEQ ID NO:169) in HUMLAP_P12 (SEQ ID NO:168).

Clinical Applications of Using the Integrin β2 Variant of the Present Invention

Since the integrin variant of the present invention, HUMLAP_P12 (SEQ ID NO:168), is a soluble extracellular protein it can be used as an integrin β2 antagonist and/or an anti-inflammatory agent in the treatment of various diseases.

Thus, the present inventors uncovered a therapeutic agent which can be used to treat an integrin β2-related disease or condition [e.g., various cancers such as breast cancer, cardiovascular disease, coronary artery bypass grafting, haemorrhage, myocardial infraction, inflammation (e.g., pulmonary inflammation, asthma, GI inflammation, bowel disorder), cerebral ischaemia, osteoporosis, reperfusion injury, transplant rejection (e.g., bone marrow transplant rejection), psoriasis, osteoporosis treatment, respiratory disease, and hepatic dysfunction. Such an agent is a polypeptide homologous to the integrin β2 variant of the present invention (SEQ ID NO:168), and/or a polynucleotide homologous to SEQ ID NO:167, and/or a peptide homologous to SEQ ID NO:169. It will be appreciated that the polypeptide, polynucleotide and/or peptide used according to this aspect of the present can be administered or provided per se, or as part of a pharmaceutical composition with a pharmaceutical acceptable carrier (e.g., PEG and liposomes).

While further reducing the present invention to practice, the present inventors have uncovered that the integrin β2 variant of the present invention HUMLAP_P12 (SEQ ID NO:168), the peptide derived therefrom (SEQ ID NO:169) and/or the polynucleotide encoding same (SEQ ID NO:167), each and in any combination, can be used as diagnostic markers for various cancers including leukemia (blood malignancies) and muscle tumors.

Diagnosis according to this aspect of the present invention is effected using immunological assays [e.g., Western Blot, immunohistochemistry, FACS analysis, radio immuno assay (RIA), immunofluorescence, and the like using an antibody directed against the integrin β2 variant (SEQ ID NO:168), or by nucleic acid techniques (NAT) such as RT-PCR, Northern Blot, in situ hybridization, in situ RT-PCR.

Example 14

Splice Variant of Low Affinity Immunoglobulin Gamma Fc Region Receptor III-A Precursor Background An essential element in the regulation of immune effector responses is via the antibody Fc receptors (FcRs) which are expressed or displayed in immune effectors. Fc receptors belong to the immunoglobulin superfamily, and have been shown to mediate the removal of antibody-coated pathogens by phagocytosis of immune complexes and the lysis of erythrocytes and various other cellular targets (e.g. tumor cells) coated with the corresponding antibody, via antibody dependent cell mediated cytotoxicity (ADCC) [Van de Winkel and Anderson, J. Leuk. Biol. 49:511-24 (1991)]. One subclass of Fc receptors includes the Fc gamma receptors, which are specific for the IgG antibodies. These include the FcγRI (CD64), FcγRII (CD32) and FcγRIII (CD16). FcγRIII is a low-affinity receptor interacting with complexed or aggregated IgG.

The Fc region receptor III-A precursor Low affinity immunoglobulin gamma Fc region receptor III-A precursor (IgG FC receptor III-2; Fc-gamma RIII-alpha; FcRIIIA; CD16-A; FcR-10), is a type-I membrane protein, which, following proteolytic cleavage can exist as a soluble receptor [e.g., neutrophil-derived soluble FcRIII (S-FcRIII)]. It is expressed on natural killer cells, macrophages, mast cells, subpopulation of T cells, immature thymocytes and placental trophoblasts. The protein contains an extracellular domain (amino acids 17-208), Ig-like C2 type 1 and 2 domains (amino acids 24-105 and 107-189, respectively), five potential glycosylation sites (amino acids 56, 63, 92, 180 and 187), two potential disulfide bonds (amino acids 47, 89; and 128, 172), a transmembrane domain (amino acids 209-229) and a potential cytoplasmic domain (amino acids 230-254); all amino acids positions relate to GenBank Accession No. P08637; SEQ ID NO:173).

Clinical Applications

The FcγRII-A exhibits an important role in the immune response. It may be involved in various diseases or conditions such as allergy reactions, anaemia, rheumatoid arthritis, asthma, inflammation, lupus erythematosus, thrombocytopenia, and thrombocytopenic purpura. In addition, abnormal accumulation of CD16+ cells was associated with large granular lymphocyte proliferative disease (Blancho G, et al., 1992, Transplantation, 53(6):1242-7) and the kidney allograft failure.

Splice Variant HUMGCRFC_T4 (SEQ ID NO:170) Encodes a New Secreted Form of FCγRIII-A, HUMGCRFC_P3 (SEQ ID NO:171)

The present inventors have uncovered a new FCγRIII-A variant [HUMGCRFC_P3 (SEQ ID NO:171); HUMGCRFC_T4 (SEQ ID NO:170)]. The protein coordinates on the transcript start from nucleotide 106 and end at nucleotide 465 as set forth in SEQ ID NO:170 (HUMGCRFC_T4 transcript).

Alignment of the new FCγRIII-A variant (HUMGCRFC_P3—SEQ ID NO:171) with the WT protein (GenBank Accession No.; SEQ ID NO:173) revealed that the new variant includes the first 107 amino acids as of the WT protein (GenBank Accession No. P08637) followed by a unique 13 amino acid sequence [ELMKGKRKITNKG (SEQ ID NO:172), FIG. 103]. The new variant uncovered by the present invention lacks the Immunoglobulin/major histocompatibility complex (IPR003006) and the Immunoglobulin subtype (IPR003599) and therefore is expected to be a secreted, soluble and extracellular protein.

Comparison Report Between HUMGCRFC_P3 and FC3A_HUMAN

1. An isolated chimeric polypeptide HUMGCRFC_P3 (SEQ ID NO:171), comprising a first amino acid sequence being at least 90% homologous to MWQLLLPTALLLLVSAGMRTEDLPKAVVFLEPQWYRVLEKDSVTLKCQGAY SPEDNSTQWFHNESLISSQASSYFIDAATVDDSGEYRCQTNLSTLSDPVQLEV HIG corresponding to amino acids 1-107 of FC3A_HUMAN (SEQ ID NO:173), which also corresponds to amino acids 1-107 of HUMGCRFC_P3 (SEQ ID NO:171), and a second amino acid sequence being at least 70%, optionally at least 80%, preferably at least 85%, more preferably at least 90% and most preferably at least 95% homologous to a polypeptide having the sequence ELMKGKRKITNKG (SEQ ID NO:172) corresponding to amino acids 108-120 of HUMGCRFC_P3 (SEQ ID NO:171), wherein said first amino acid sequence and second amino acid sequence are contiguous and in a sequential order.

2. An isolated polypeptide for a tail of HUMGCRFC_P3 (SEQ ID NO:171), comprising a polypeptide being at least 70%, optionally at least about 80%, preferably at least about 85%, more preferably at least about 90% and most preferably at least about 95% homologous to the sequence ELMKGKR-KITNKG (SEQ ID NO:172) in HUMGCRFC_P3 (SEQ ID NO:171).

Splice Variant HUMGCRFC_T5 (SEQ ID NO:174) Encodes a New Secreted Form of the FCγRIII-A, HUMGCR-FC_P4 (SEQ ID NO:175)

The present inventors have uncovered a new FCγRIII-A variant [HUMGCRFC_T5—SEQ ID NO:174; HUMGCR-FC_P4—SEQ ID NO:175]. The protein coordinates on the transcript start from nucleotide 106 and end at nucleotide 483 as set forth in SEQ ID NO:174 (HUMGCRFC_T5 transcript).

Alignment of the new FCγRIII-A variant (HUMGCR-FC_P4—SEQ ID NO:175) with the WT protein (GenBank Accession No. P08637; FC3A_HUMAN; SEQ ID NO:173) revealed that the new variant includes the first 107 amino acids as of the WT protein (GenBank Accession No. P08637) followed by a unique 19 amino acid sequence [PFPTMTSC-SLFVKSDYLVT (SEQ ID NO:176), FIG. 104]. The new variant uncovered by the present invention lacks the immunoglobulin/major histocompatibility complex (IPR003006) and immunoglobulin subtype (IPR003599) domain of the WT protein and therefore is expected to be a secreted, soluble protein (i.e., extracellular).

Comparison Report Between HUMGCRFC_P4 (SEQ ID NO:175) and FC3A_HUMAN (SEQ ID NO:173)

1. An isolated chimeric polypeptide HUMGCRFC_P4 (SEQ ID NO:175), comprising a first amino acid sequence being at least 90% homologous to MWQLLLP-TALLLLVSAGMRTEDLPKAVVFLEPQW-YRVLEKDSVTLKCQGAY SPEDNSTQWFHNESLIS-SQASSYFIDAATVDDSGEYRCQTNLSTLSDPVQLEV HIG corresponding to amino acids 1-107 of FC3A_HUMAN (SEQ ID NO:173), which also corresponds to amino acids 1-107 of HUMGCRFC_P4 (SEQ ID NO:175), and a second amino acid sequence being at least 70%, optionally at least 80%, preferably at least 85%, more preferably at least 90% and most preferably at least % homologous to a polypeptide having the sequence PFPTMTSCSLFVKSDYLVT (SEQ ID NO:176) corresponding to amino acids 108-126 of HUMGCRFC_P4 (SEQ ID NO:175), wherein said first amino acid sequence and second amino acid sequence are contiguous and in a sequential order.

2. An isolated polypeptide for a tail of HUMGCRFC_P4 (SEQ ID NO:175), comprising a polypeptide being at least 70%, optionally at least about 80%, preferably at least about 85%, more preferably at least about 90% and most preferably at least about 95% homologous to the sequence PFPTMTSC-SLFVKSDYLVT (SEQ ID NO:176) in HUMGCRFC_P4 (SEQ ID NO:175).

Clinical Applications of the New FORM-A Variants

Since the variants uncovered by the present inventors, HUMGCRFC_P3 (SEQ ID NO:171) and HUMGCRFC_P4 (SEQ ID NO:175), include the first 107 amino acids of the WT FCγRIII-A, but yet, are missing the transmembrane domain and the immunoglobulin/major histocompatibility complex and immunoglobulin subtype domains, they can be used as antagonists for the endogenous FCγRIII-A. Thus, the FCγRIII-A variants of the present invention, SEQ ID NO:171 and/or SEQ ID NO:175 can be used as an anti-inflammatory, antiallergic, anti-asthma, antianaemic, antithrombotic, antiarthritic agent as well as an immunological, a cytokine, and an immunosuppressant agent.

Thus, the present inventors uncovered a therapeutic agent which can be used to treat inflammation, allergy, asthma, anaemic, thrombosis, and/or arthritis. Such an agent is a polypeptide homologous to SEQ ID NO:171 or 175, and/or a polynucleotide homologous to SEQ ID NO:174 or 170.

While further reducing the present invention to practice, the new variants of the present invention (HUMGCR-FC_P3—SEQ ID NO:171 and/or HUMGCRFC_P4—SEQ ID NO: 175), the polynucleotide encoding same (HUMGCR-FC_T4 (SEQ ID NO:170 and/or HUMGCRFC_T5—SEQ ID NO:174) and/or the peptide(s) derived from such variants (SEQ ID NO:172 and/or 176) can be used as diagnostic markers for allergy reactions, anaemia, rheumatoid arthritis, asthma, inflammation, lupus erythematosus, thrombocytopenia, thrombocytopenic purpura, large granular lymphocyte proliferative disease, and/or susceptibility to allograft failure (e.g., kidney allograft failure). Diagnosis according to this aspect of the present invention is effected using immunological assays [e.g., Western Blot, immunohistochemistry, FACS analysis, radio immuno assay (RIA), immunofluorescence, and the like using an antibody directed against the HUMGCRFC_P3 and/or HUMGCRFC_P4 (SEQ ID NO:171 and/or 175, respectively), or by nucleic acid techniques (NAT) such as RT-PCR, Northern Blot, in situ hybridization, in situ RT-PCR.

Example 15

Splice Variant of Tumor Necrosis Factor Receptor Superfamily Member 3 Precursor

Background

Lymphotoxin-β receptor (LT-βR) is a member of the tumor necrosis factor receptor (TNFR) superfamily and is expressed on the surface of most of cell types, including cells of epithelial and myeloid lineages but not on T and B lymphocytes. LT-βR can specifically bind two ligands: the membrane form of lymphotoxin, LT-α1/β2, which is uniquely expressed on activated lymphoid cells and LIGHT, a member of the TNF superfamily, which is induced on the cell surface during T cell activation. LT-βR has been speculated to play an essential role in the development of lymphoid organs. Thus, LT-β knockout mice exhibit impaired lymph node development and loss of splenic architecture. In addition, LT-βR deficient mice were found to lack Peyer's patches, colon-associated lymphoid tissues and all lymph nodes. Moreover, stimulation of LT-βR on certain cell lines by LT-α1/β2 or anti-LTβR antibodies was found to induce cell death, chemokine secretion, and activation of nuclear factor κB (NFκB), suggesting an important biological function for LT-βR in mature individuals.

Like other members of the TNF receptor family, the cytoplasmic domain (CD) of LT-βR does not include consensus sequences characteristic of enzymatic activity. Thus, signaling is thought to be mediated by the proteins interacting with LT-βR such as the two serine/threonine protein kinases, p50 and p80 and the two members of the TNF receptor-associated factor (TRAF) family, TRAF3 and TRAF5, which specifically associate with the LT-βR(CD). Further study has indicated that TRAF3 plays an important role in mediating LT-βR-induced apoptosis, whereas TRAF5 involves in the activation of NFκB. On the other hand, several members of the TNFR superfamily (such as TNFRI, Fas, DR3, DR4, and DR5) contain a common motif, the death domain, in their cytoplasmic region that initiate the activation of caspase cascades to execute apoptosis. LT-βR(CD) does not contain a death domain, but signaling through LT-βR can also induce apoptosis. It was shown that the cytoplasmic domain of TNFRI can self-associate through its death domain, therefore overexpression of TNFRI or of the cytoplasmic domain thereof can induce receptor clustering, a crucial step for subsequent intracellular signaling. Despite the absence of the death domain, the LT-βR(CD) is capable of self-association. Thus, overexpression of LT-βR is sufficient to trigger apoptosis without the need for ligand conjugation (Tamada et al. 2002. The Journal of Clinical Investigation. Vol. 109, No. 4, Pp. 549-557; Shao et al. 2003. Eur. J. Immunol. 33:1736-1743; Ettinger et al. 1996. Proc. Natl. Acad. Sci. USA. Vol. 93, Pp. 13102-13107; Wu et al. 1999. The Journal of Biological Chemistry. Vol. 274, No. 17, Pp. 11868-11873; Hehlgans et al. 2002. Cancer Research 62:4034-4040).

Clinical Application

It has been shown that signaling through LT-βR induced cell death in some human adenocarcinoma tumor lines (HT-29 and WiDr) in the presence of IFN-γ. Combined in vivo treatment of human adenocarcinoma cells (WiDr), which form solid tumors in immunocompromised mice, with an agonistic anti-LT-βR antibody and human IFN-γ resulted in tumor growth arrest. Contrary to these findings, it has been shown that activation of LT-βR on fibrosarcoma tumor cells is necessary for angiogenesis and solid tumor growth. Prevention of LT-α1/β2-LT-βR signaling, by the release of LTβR-Fc from the tumor cells, inhibited tumor angiogenesis and neovascularization, and resulted in tumor growth arrest in mice. In addition, LT-βR activation on the tumor cells induced enhanced release of MIP-2, an angiogenic CXC chemokine. Thus, the interaction of activated LT-α1/β2-carrying lymphocytes with LT-βR-expressing tumor cells can initiate a novel pro-angiogenic pathway, leading to organized tumor tissue development. In addition to its modulation of tumor growth, LT-βR was shown to be involved in immune regulation. In vivo blockade of LIGHT and LTα1/β2 by administration of soluble lymphotoxin β receptor-Ig (LTβR-Ig) inhibited the cytotoxic T lymphocyte (CTL) response to host antigenic disparities and ameliorated lethal graft-versus-host disease (GVHD) in a B6 to BDF1 mouse model. In addition, it has been shown that treatment of rodents with the fusion protein, LT-βR-Ig, prevents the development of autoimmune diseases as insulitis and uveitis.

TNR3-LT-βR Splice Variant T2 Structure

A brief description is now provided of TNR3-LT-βR splice variants according to the present invention. TNR3 splice variant transcript_2 (HUMTNFRRP_T2—SEQ ID NO:177; HUMTNFRRP_P2—SEQ ID NO:178). The protein coordinates on the transcript start from nucleotide 261 and end at nucleotide 1025 as set forth in SEQ ID NO:177.

TNR3 splice variant T2 results from alternative splicing of the TNR3 gene, introducing a novel exon, named exon 6a, between exons 6 and 7, leading to an insertion of a stop codon and the generation of a truncated protein. TNR3 splice variant T2 encodes a 255 amino acids long protein (HUMTNFRRP_P2—SEQ ID NO:178) which contains the N-terminal signal sequence (residues 1-30), the complete extracellular domain of TNR3, including all the TNFR CYS repeats, and a unique sequence of 33 amino acids [EPALSKGVENLQAL-LYQAATGSSEASFPTLSPL (SEQ ID NO:179), FIG. 105] at the C-terminus of the protein. However, as can see using the alignment with the WT sequence (TNR3_HUMAN; SEQ ID NO:129), the new variant uncovered by the present invention lacks the transmembrane domain (amino acids 228-248 of SEQ ID NO:129) and therefore is expected to be a secreted, soluble and extracellular protein.

Comparison Report Between HUMTNFRRP_P2 (SEQ ID NO:178) and TNR3_HUMAN (SEQ ID NO:129)

1. An isolated chimeric polypeptide HUMTNFRRP_P2 (SEQ ID NO:178), comprising a first amino acid sequence being at least 90% homologous to MLLPWATSAPGLAWG-PLVLGLFGLLAASQPQAVPPYASENQTCRDQEKEYY EPQHRICCSRCPPGTYVSAKCSRIRDTV-CATCAENSYNEHWNYLTICQLCRPC DPVMGLEE-IAPCTSKRKTQCRCQPGMFCAAWA-LECTHCELLSDCPPGTEAEL KDEVGKGNNHCVPCKAGHFQNTSSP-SARCQPHTRCENQGLVEAAPGTAQSD TTCKNPLE-PLPPEMS corresponding to amino acids 1-222 of TNR3_HUMAN (SEQ ID NO:129), which also corresponds to amino acids 1-222 of HUMTNFRRP_P2 (SEQ ID NO:178), and a second amino acid sequence being at least 70%, optionally at least 80%, preferably at least 85%, more preferably at least 90% and most preferably at least 95% homologous to a polypeptide having the sequence EPAL-SKGVENLQALLYQAATGSSEASFPTLSPL (SEQ ID NO:179) corresponding to amino acids 223-255 of HUMT-NFRRP_P2 (SEQ ID NO:178), wherein said first amino acid sequence and second amino acid sequence are contiguous and in a sequential order.

2. An isolated polypeptide for a tail of HUMTNFRRP_P2 (SEQ ID NO:178), comprising a polypeptide being at least 70%, optionally at least about 80%, preferably at least about 85%, more preferably at least about 90% and most preferably at least about 95% homologous to the sequence EPAL-SKGVENLQALLYQAATGSSEASFPTLSPL (SEQ ID NO:179) in HUMTNFRRP_P2 (SEQ ID NO:178).

TNR3-LT-βR Splice Variant T18 Structure

TNR3 splice variant transcript_18 (HUMTNFR-RP_T18—SEQ ID NO:180; HUMTNFRRP_P2—SEQ ID NO:178). The protein coordinates on the transcript start from nucleotide 261 and end at nucleotide 1025 as set forth in SEQ ID NO:180. The protein encoded by this transcript (SEQ ID NO:180) is identical to the protein encoded by HUMTNFR-RP_T2—SEQ ID NO:177, and is referred to herein as HUMTNFRRP_P2—SEQ ID NO:178.

The Therapeutic Potential of TNR3-LT-βR Splice Variants T2 and T18

TNR3 splice variants T2 and T18, each encode a soluble receptor which contains all four TNFR CYS repeats of the WT or known protein (TNR3_HUMAN; SEQ ID NO:129), but yet is a soluble, secreted protein. It can inhibit TNR3 signaling by competing on the ligand with the membrane-bound receptor, thus preventing LT-α1/β2 from binding to the cell surface receptor and activating it. A soluble form of TNR3 was shown already to bind LT-α1/β2 in vitro. Blocking LTαβ/TNR3 interactions was shown in vivo by administration of TNR3-Fc fusion protein or by the creation of mice which constitutively express a soluble murine TNR3-human IgG1 (Fc) transgene. Blocking TNR3 signaling could have important therapeutic potential for the treatment of cancer, graft-vs-host disease and autoimmune diseases, such as rheumatoid arthritis, Crohn's disease, insulitis and uveitis.

Thus, the TNR3 HUMTNFRRP_P2 (SEQ ID NO:178) of the present invention, the polynucleotide encoding same (TNR3 splice variants T2 and T18, SEQ ID NOs:177 and 180, respectively) and/or the unique peptide derived from the TNR3 HUMTNFRRP_P2 variant of the present invention (SEQ ID NO:179) can serve as a TNFR3 antagonist.

The present inventors uncovered a therapeutic agent which can be used to: (i) inhibit or prevent the binding of LT-α1/β2 to its TNR3 receptor in vivo or ex vivo, (ii) prevent tumor growth (e.g., solid tumor, such as fibrisarcoma) by preventing the activation of LT-βR, (iii) prevent and/or treat graft-versus-host disease (GVHD) by inhibition of the cytotoxic T lymphocyte (CTL) response, (iv) prevent and/or treat autoimmune diseases (e.g., insulitis, uveitis), (v) prevent and/or treat Crohn's disease, rheumatoid arthritis. Such an agent is a polypeptide homologous to HUMTNFRRP_P2 (SEQ ID NO:178), and/or a polynucleotide homologous to SEQ ID NO: 177 or 180 and/or a peptide homologous to SEQ ID NO:179). It will be appreciated that the polypeptide, polynucleotide and/or peptide used according to this aspect of the present can be administered or provided per se, or as part of a pharmaceutical composition with a pharmaceutical acceptable carrier (e.g., PEG and liposomes).

While further reducing the present invention to practice, the present inventor have uncovered that the TNR3 variant of the present invention is overexpressed in various cancers (e.g., stomach tumor) and therefore can be used as a diagnostic marker for such pathologies.

Diagnosis according to this aspect of the present invention is effected using immunological assays [e.g., Western Blot, immunohistochemistry, FACS analysis, radio immuno assay (RIA), immunofluorescence, and the like using an antibody directed against the HUMTNFRRP_P2 variant (SEQ ID NO:178), or by nucleic acid techniques (NAT) such as RT-PCR, Northern Blot, in situ hybridization, in situ RT-PCR.

Example 16

Splice Variant of Granulocyte Colony Stimulating Factor Receptor Precursor (G-CSF-R)

Background

The granulocyte colony stimulating factor receptor precursor (G-CSF-R) (CD114 antigen, GCSR_HUMAN; GenBank Accession No. Q99062) is a type I membrane protein which involves in cell adhesion, signal transduction, and defense response.

Clinical Applications

G-CSF-R has been implicated in anaemia, various cancers such as, breast cancer, leukaemia, acute myelogenous, leukaemia, lymphoma, melanoma, sarcoma, chemotherapy-induced injury, bone marrow, bone marrow leucopenia, bone marrow neutropenia, immunodeficiency, and infections.

The G-CSF-R is overexpressed in amniotic cells and placenta and thus can be used as a marker for cell proliferation in these tissues and as a marker for pathological de-differentiation of these tissues.

Splice Variant HSGCSFR2_T14 (SEQ ID NO:181) Encodes a New Secreted Form of the G-CSF-R, HSGCSFR2_P11 (SEQ ID NO:182)

The present inventors have uncovered a new G-CSF-R variant [HSGCSFR2_P11—SEQ ID NO:182; HSGCSFR2_T14—SEQ ID NO:181]. The protein coordinates on the transcript start from nucleotide 551 and end at nucleotide 2320 as set forth in SEQ ID NO:181 (HSGCSFR2_T14 transcript).

Alignment of the new G-CSF-R variant HSGCSFR2_P11—SEQ ID NO:182) with the WT protein (GenBank Accession No. Q99062; GCSR_HUMAN; SEQ ID NO:183) revealed that the new variant includes the first 525 amino acids as of the WT protein (GenBank Accession No. Q99062) followed by a unique 65 amino acid sequence [GLSTIRPLSRILSSLSQGSAWSPAIR-SIGNIAFLPYFQPWRGSLPIPW LTLDPYSWTEIRCW-DRN (SEQ ID NO:184), FIG. 106]. The new variant uncovered by the present invention lacks the fibronectin type-III domain (IPR003961; amino acids 527-618 in WT; SEQ ID NO:183) and the transmembrane domain (amino acids 628-650 of GenBank Accession No. Q99062; SEQ ID NO:183) of the WT protein and therefore is expected to be a secreted, soluble protein (i.e., extracellular).

Comparison Report Between HSGCSFR2_P11 and GCSR_HUMAN

1. An isolated chimeric polypeptide HSGCSFR2_P11 (SEQ ID NO:182), comprising a first amino acid sequence being at least 90% homologous to MARLGNCSLTWAALI-ILLLPGSLEECGHISVSAPIVHLGDPITASCIIKQNCSHL DPEPQILWRLGAELQPGGRQQRLS-DGTQESIITLPHLNHTQAFLSCCLNWGNS LQILDQVELRAGYPPAIPHNLSCLMN-LTTSSLICQWEPGPETHLPTSFTLKSFKS RGNC-QTQGDSILDCVPKDGQSHC-CIPRKHLLLYQNMGIWVQAENALGTSMSP QLCLDPMDVVKLEPPMLRTMDPSPEAAP-PQAGCLQLCWEPWQPGLHINQKC ELRHKPQR-GEASWALVGPLPLEALQYELCGLL-PATAYTLQIRCIRWPLPGHW SDWSPSLELRTTERAPTVRLDTW-WRQRQLDPRTVQLFWKPVPLEEDSGRIQG YVVSWRPSGQAGAILPLCNTTELSCTF-HLPSEAQEVALVAYNSAGTSRPTPVV FSESRGPALTR-LHAMARDPHSLWVGWEPPNPWPQGY-VIEWGLGPPSASNSN KTWRMEQNGRATGFLLKENIRPFQLYEI-IVTPLYQDTMGPSQHVYAYSQEM corresponding to amino acids 1-525 of GCSR_HUMAN (SEQ ID NO:183), which also corresponds to amino acids 1-525 of HSGCSFR2_P11 (SEQ ID NO:182), and a second amino acid sequence being at least 70%, optionally at least 80%, preferably at least 85%, more preferably at least 90% and most preferably at least 95% homologous to a polypeptide having the sequence GLSTIRPLSRILSSLSQGSAWSPAIR-SIGNIAFLPYFQPWRGSLPIPWLTLDPYSW TEIRCW-DRN (SEQ ID NO:184) corresponding to amino acids 526-590 of HSGCSFR2_P11 (SEQ ID NO:182), wherein said first amino acid sequence and second amino acid sequence are contiguous and in a sequential order.

2. An isolated polypeptide for a tail of HSGCSFR2_P11 (SEQ ID NO:182), comprising a polypeptide being at least 70%, optionally at least about 80%, preferably at least about 85%, more preferably at least about 90% and most preferably at least about 95% homologous to the sequence GLSTIR-PLSRILSSLSQGSAWSPAIR-SIGNIAFLPYFQPWRGSLPIPWLTLDPYSW TEIRCW-DRN (SEQ ID NO:184) in HSGCSFR2_P11 (SEQ ID NO:182).

Splice Variant HSGCSFR2_T8 (SEQ ID NO:185) Encodes a New Secreted Form of the G-CSF-R, HSGCSFR2_P7 (SEQ ID NO:186)

The present inventors have uncovered a new G-CSF-R variant [HSGCSFR2_P7—SEQ ID NO:186; HSGCSFR2_T8—SEQ ID NO:185]. The protein coordinates on the transcript start from nucleotide 551 and end at nucleotide 2281 as set forth in SEQ ID NO:185 (HSGCSFR2_T8 transcript).

Alignment of the new G-CSF-R variant (HSGCSFR2_P7—SEQ ID NO:186) with the WT protein (GenBank Accession No. Q99062; SEQ ID NO:183) revealed that the new variant includes the first 574 amino acids as of the WT protein (GenBank Accession No. Q99062) and is missing 66 amino acid sequence [SAILNASSRGFV-LHGLEPASLYHIHLMAASQAGATNSTV- LTLMTLTPEGSELH IILGLFGLLLLLT (SEQ ID NO:187), FIG. 107]. The new variant uncovered by the present invention exhibits a truncated fibronectin type-III domain (IPR003961; amino acids 527-618 in WT; GenBank Accession No. Q99062) and lacks the transmembrane domain of the WT protein (amino acids 628-650 of GenBank Accession No. Q99062) and therefore is expected to be a secreted, soluble protein (i.e., extracellular).

Comparison Report Between HSGCSFR2_P7 and GCSR_HUMAN

1. An isolated chimeric polypeptide HSGCSFR2_P7, comprising a first amino acid sequence being at least 90% homologous to MARLGNCSLTWAALIILLL-PGSLEECGHISVSAPIVHLGDPITASCIIKQNCSHL DPEPQILWRLGAELQPGGRQQRLS-DGTQESIITLPHLNHTQAFLSCCLNWGNS LQILDQVELRAGYPPAIPHNLSCLMN-LTTSSLICQWEPGPETHLPTSFTLKSFKS RGNC-QTQGDSILDCVPKDGQSHC-CIPRKHLLLYQNMGIWVQAENALGTSMSP QLCLDPMDVVKLEPPMLRTMDPSPEAAP-PQAGCLQLCWEPWQPGLHINQKC ELRHKPQR-GEASWALVGPLPLEALQYELCGLL-PATAYTLQIRCIRWPLPGHW SDWSPSLELRTTERAPTVRLDTW-WRQRQLDPRTVQLFWKPVPLEEDSGRIQG YVVSWRPSGQAGAILPLCNTTELSCTF-HLPSEAQEVALVAYNSAGTSRPTPVV FSESRGPALTR-LHAMARDPHSLWVGWEPPNPWPQGY-VIEWGLGPPSASNSN KTWRMEQNGRATGFLLKENIRPFQLYEI-IVTPLYQDTMGPSQHVYAYSQEMA PSHAPELHLKHIGKTWAQLEWVPEPPEL-GKSPLTHYTIFWTNAQNQSF corresponding to amino acids 1-574 of GCSR_HUMAN (SEQ ID NO:183), which also corresponds to amino acids 1-574 of HSGCSFR2_P7 (SEQ ID NO:186), and a second amino acid sequence being at least 70%, optionally at least 80%, preferably at least 85%, more preferably at least 90% and most preferably at least 95% homologous to a polypeptide having the sequence CLC corresponding to amino acids 575-577 of HSGCSFR2_P7 (SEQ ID NO:186), wherein said first amino acid sequence and second amino acid sequence are contiguous and in a sequential order.

Splice Variant HSGCSFR2_T9 (SEQ ID NO:188) Encodes a New Secreted Form of the G-CSF-R, HSGCSFR2_P8 (SEQ ID NO:189)

The present inventors have uncovered a new G-CSF-R variant [HSGCSFR2_P8—SEQ ID NO:189; HSGCSFR2_T9—SEQ ID NO:188]. The protein coordinates on the transcript start from nucleotide 551 and end at nucleotide 2365 as set forth in SEQ ID NO:188 (HSGCSFR2_T9 transcript).

Alignment of the new G-CSF-R variant (HSGCSFR2_P8—SEQ ID NO:189) with the WT protein (GenBank Accession No. Q99062; SEQ ID NO:183) revealed that the new variant includes the first 574 amino acids as of the WT protein (GenBank Accession No. Q99062), followed by 31 amino acid sequence [CESILSSPTAPEGLEGGAQLPRRQLYHPGLC (SEQ ID NO:190), FIG. 108]. The new variant uncovered by the present invention exhibits a truncated fibronectin type-III domain (IPR003961; amino acids 527-618 in WT; GenBank Accession No. Q99062) and lacks the transmembrane domain of the WT protein (amino acids 628-650 of GenBank Accession No. Q99062) and therefore is expected to be a secreted, soluble protein (i.e., extracellular).

Comparison Report Between HSGCSFR2_P8 and GCSR_HUMAN

1. An isolated chimeric polypeptide HSGCSFR2_P8 (SEQ ID NO:189), comprising a first amino acid sequence being at least 90% homologous to MARLGNCSLTWAALIILLL-PGSLEECGHISVSAPIVHLGDPITASCIIKQNCSHL DPEPQILWRLGAELQPGGRQQRLS-DGTQESIITLPHLNHTQAFLSCCLNWGNS LQILDQVELRAGYPPAIPHNLSCLMN-LTTSSLICQWEPGPETHLPTSFTLKSFKS RGNC-QTQGDSILDCVPKDGQSHC-CIPRKHLLLYQNMGIWVQAENALGTSMSP QLCLDPMDVVKLEPPMLRTMDPSPEAAP-PQAGCLQLCWEPWQPGLHINQKC ELRHKPQR-GEASWALVGPLPLEALQYELCGLL-PATAYTLQIRCIRWPLPGHW SDWSPSLELRTTERAPTVRLDTW-WRQRQLDPRTVQLFWKPVPLEEDSGRIQG YVVSWRPSGQAGAILPLCNTTELSCTF-HLPSEAQEVALVAYNSAGTSRPTPVV FSESRGPALTR-LHAMARDPHSLWVGWEPPNPWPQGY-VIEWGLGPPSASNSN KTWRMEQNGRATGFLLKENIRPFQLYEI-IVTPLYQDTMGPSQHVYAYSQEMA PSHAPELHLKHIGKTWAQLEWVPEPPEL-GKSPLTHYTIFWTNAQNQSF corresponding to amino acids 1-574 of GCSR_HUMAN (SEQ ID NO:183), which also corresponds to amino acids 1-574 of HSGCSFR2_P8 (SEQ ID NO:189), and a second amino acid sequence being at least 70%, optionally at least 80%, preferably at least 85%, more preferably at least 90% and most preferably at least 95% homologous to a polypeptide having the sequence CESILSSPTAPEGLEGGAQLPRRQLYHPGLC (SEQ ID NO:190) corresponding to amino acids 575-605 of HSGCSFR2_P8 (SEQ ID NO:189), wherein said first amino acid sequence and second amino acid sequence are contiguous and in a sequential order.

2. An isolated polypeptide for a tail of HSGCSFR2_P8 (SEQ ID NO:189), comprising a polypeptide being at least 70%, optionally at least about 80%, preferably at least about 85%, more preferably at least about 90% and most preferably at least about 95% homologous to the sequence CESILSSPTAPEGLEGGAQLPRRQLYHPGLC (SEQ ID NO:190) in HSGCSFR2_P8 (SEQ ID NO:189).

The expected pharmacological activity of the soluble G-CSF-R variants of the present invention (HSGCSFR2_P11, HSGCSFR2_P7 and HSGCSFR2_P8) are agonists of the granulocyte stimulating factor.

These results suggest the use of the new G-CSF-R variants of the present invention [HSGCSFR2_P11 (SEQ ID NO:182), HSGCSFR2_P7 (SEQ ID NO:186), and/or HSGCSFR2_P8 (SEQ ID NO:189)], the polynucleotides encoding same [HSGCSFR2_T14 (SEQ ID NO:181), HSGCSFR2_T8 (SEQ ID NO:185) and/or HSGCSFR2_T9 (SEQ ID NO:188)] and/or the peptides derived from the HSGCSFR2_P11 variant (SEQ ID NO:184) and/or the HSGCSFR2_P8 (SEQ ID NO:190) as a diagnostic marker for amniotic and/or placental cell proliferation or de-differentiation, as well as various tumors. Diagnosis according to this aspect of the present invention is effected using immunological assays [e.g., Western Blot, immunohistochemistry, FACS analysis, radio immuno assay (RIA), immunofluorescence, and the like using an antibody directed against the G-CSF-R variant (HSGCSFR2_P11—SEQ ID NO:182], nucleic acid techniques (NAT) such as RT-PCR, Northern Blot, in situ hybridization, in situ RT-PCR.

Moreover, G-CSF-R is implicated in various hematological and immunological conditions. Thus, the present inventors have uncovered that the new soluble form of G-CSF-R which can be used as an antianaemic, anticancer, immunomodulator, anti-infective, immunostimulant, radio or chemoprotective, anti-AIDS therapeutic agent.

It will be appreciated that such an agent can be administered or provided to an individual in need thereof per se or as part of a pharmaceutical composition with a pharmaceutical acceptable carrier (e.g., PEG and liposomes).

Example 17

Splice Variant of E-Selectin Precursor

Background

E-selectin (CD62E, ELAM-1) is a member of the selectins (CD62) family which also includes L-selectin (CD62L, LECAM-1, LAM-1) and P-selectin (CD62P, GMP140, PADGEM). E-selectin participates in recruiting leukocytes to sites of inflammation. Its expression is restricted in most cases to venules in site of acute and chronic inflammation and it was found to be expressed on cytokine-(TNFα, IL-1) activated endothelial cells. Furthermore, it is rapidly (within 4 hours) expressed on postcapillary venules in animal models of inflammation, supporting a role for this protein in the initial stages of the inflammatory response such as neutrophil recruitment. However, it seems that E-selectin expression is necessary but insufficient for T cell emigration into skin. Furthermore, E-selectin has some functional redundancy with P-selectin as in a model of DTH (T cell-mediated delayed type hypersensitivity) in E-selectin null mice P-selectin can compensate for the inflammatory response. Although upregulated upon stimulation by inflammatory cytokines, constitutive low levels of E-selectin expression appear to play a role in normal leukocyte trafficking.

Structurally, E-selectin contains an N-terminal C-type lectin domain (also designated carbohydrate-recognition domain, CRD), followed by an epidermal growth factor (EGF)-like domain, six short consensus repeats (SCRs, also designated sushi), a transmembrane domain, and a short cytoplasmic tail. The lectin domain of E-selectin is required for carbohydrate binding. However, mutagenesis studies have shown that although the c-lectin and EGF-like domains are the minimal functional unit, the presence of the six SCRs yields the most potent molecule in terms of binding of the E-selectin to cell surface and in inhibition of adhesion (Li et al., 1994).

Several cell types interact with E-selectin-expressing endothelium including myeloid cells, neutrophils, monocytes and certain subsets of lymphocytes (CD4, CD8 and memory). This interaction occurs via the recognition of carbohydrated, usually sialyl Lewis x (SLex)-bearing selectin ligands, including PSGL-1 (P-selectin glycoprotein ligand-1), L-selectin and CLA (cutaneous lymphocyte associated antigen).

Clinical Applications

Chronic inflammation that results from unregulated leukocyte interaction with the endothelium is reported in ischemia-reperfusion, rheumatoid arthritis, asthma, atherosclerosis, and multiple sclerosis. Additionally, E-selectin over expression and/or CLA+ T cell infiltrates have been associated with a number of chronic skin diseases such as atopic dermatitis, psoriasis, allergic contact dermatitis, cutaneous T cell lymphoma and other diseases (Rossiter et al., 1997). The chronic inflammatory response associated with overexpression of selectins is due, at least in part, to increased cytokine production by extravasated T cells that have encountered antigen and became activated Inhibition of extravasation by blocking selectins could prevent the initial accumulation in tissue, thereby preventing the subsequent production of cytokines. Interestingly, studies employing selectin knock out mice have shown that E-selectin null mice lacks a pathogenic phenotype (Frenette and Wagner, 1997).

E-selectin interaction with carbohydrates (mainly sialyl Lewis a but also x) have also been implicated in formation of metastases of several cancer cells. High amounts of sialyl Lewis (a) are present in human adenocarcinomas of the colon, pancreas and stomach. There are several lines of evidence showing that sialyl Lewis (a) is responsible for the adhesion of human cancer cells to endothelium. E-selectin present on endothelial cells mediates these interactions. Thus, E-selectin antagonists might block E-selectin/cancer cell contact and reduce the metastatic potential of the cancer cells (Ugorski and Laskowska, 2002). Additionally, E-selectin expression was shown to be involved in lymphocyte recruitment to the skin of patients with GvHD (Lange et al., 1995).

Elevated serum levels of soluble E-selectin could serve as a diagnostic marker of chronic inflammatory diseases and cancer as high levels of soluble E-selectin have been described in patients suffering from type II diabetes (Matsumoto et al., 2002), rheumatoid arthritis (Klimiuk et al., 2002), asthma (Hamzaoui et al., 2001), lupus, sepsis (Egerer et al., 2000), and colorectal and breast cancer (Ito et al., 2001, Matsuura et al., 1997). Furthermore, suppression of experimental lupus nephritis by elevated expression of soluble E-selectin in transgenic mice was reported (Takahashi et al., 2002), indicating that soluble E-selectin could also serve as a therapeutic protein in inflammation-associated diseases, even if high levels of the soluble molecules are present in the serum of these patients.

Splice Variant Structure

Figure 38:
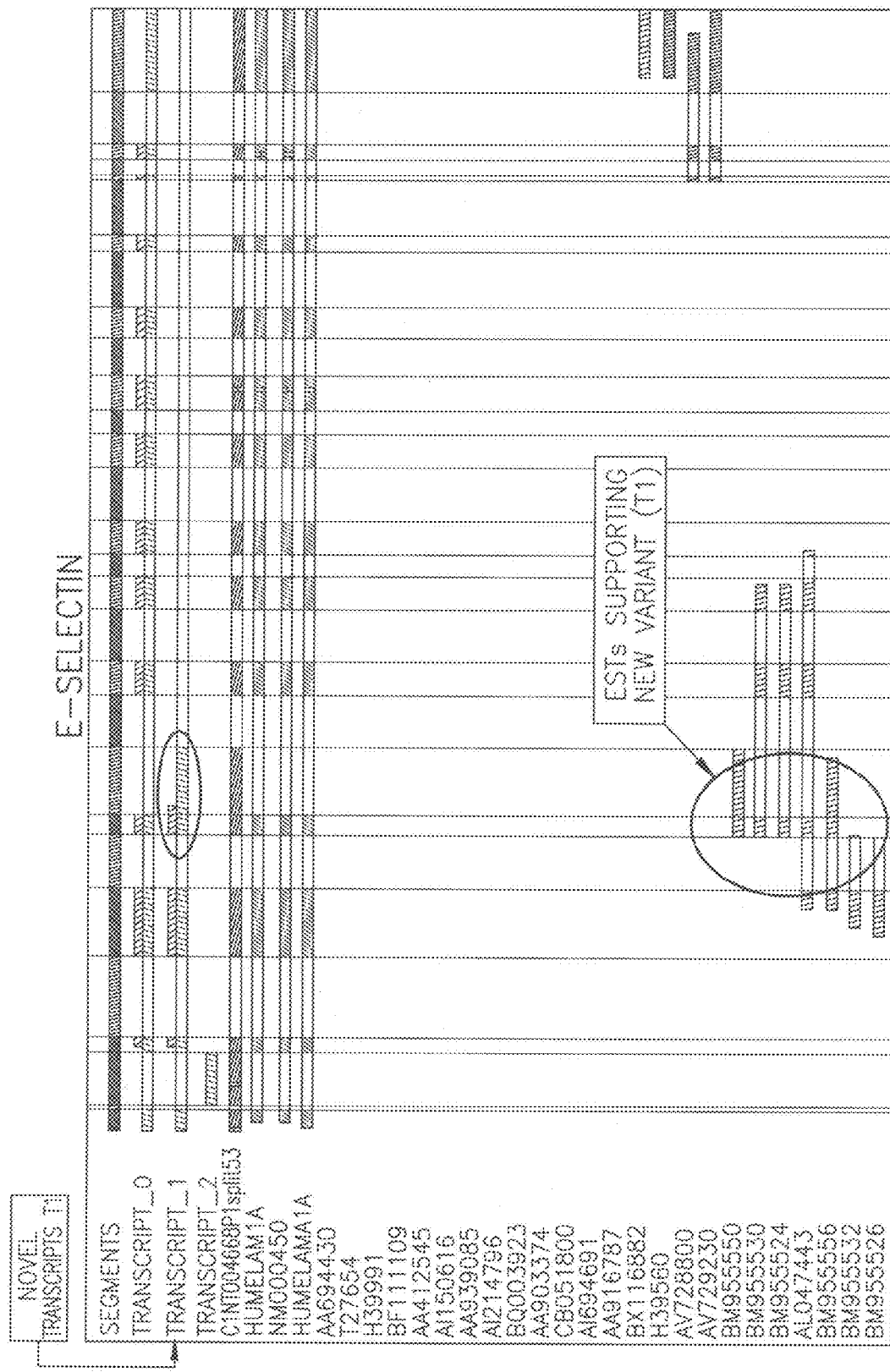
FIG. 38 is a schematic illustration depicting the graphical viewer scheme presenting the new variant of E-Selectin (transcript_1) as compared to the wild type mRNA. The ESTs supporting the new variant are indicated. Transcript indicated as "0" represents known mRNA. The pattern code is as in FIG. 2.
Figure 40:
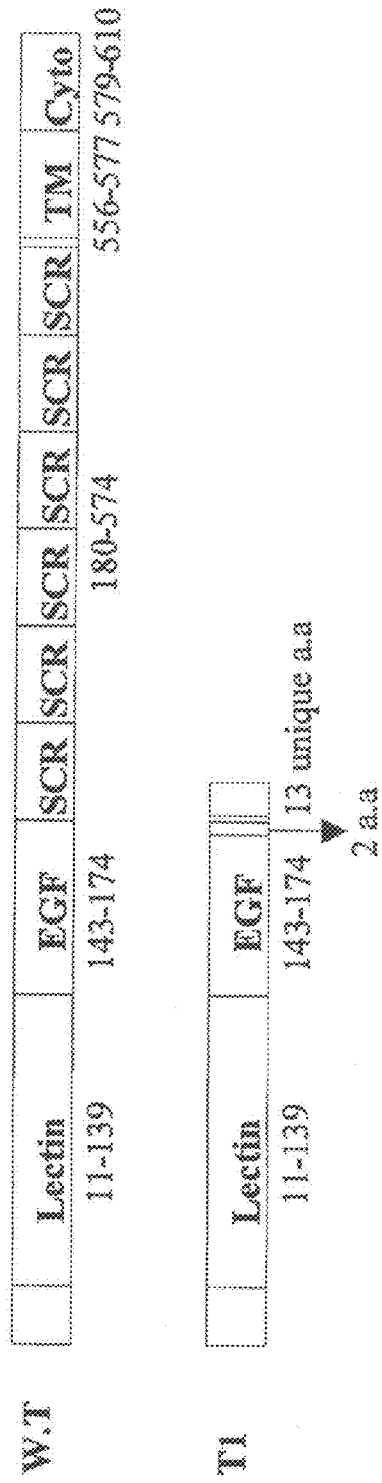
FIG. 40 is a schematic illustration showing the protein domain structure of wild-type E-Selectin (SwissProt locus: LEM2_HUMAN; SEQ ID NO:139) and the variant of the present invention (SEQ ID NO:65). Unique region is indicated (SEQ ID NO:67).

The present inventors uncovered a novel splice variant of E-selectin (HUMELAM1A_P2—SEQ ID NO:65 and HUMELAM1A_T1—SEQ ID NO:66; FIGS. 37*b* and a, respectively). The splice variant HUMELAM1A_T1 was obtained by the alternative splicing of the E-selectin gene resulting in extension of exon 4 leading to an insertion of a stop codon and the generation of a truncated protein (FIGS. 38-40). This splice variant encodes 189 amino acids long protein (SEQ ID NO:65), which contains 176 amino acids of the wild type sequence, and a unique sequence of 13 amino acids (SKSGSCLFLHLRW; SEQ ID NO:67). It encompasses the C-type lectin domain, the EGF-like domain, but lacks the six SCR (sushi) domains, the TM and the cytoplasmic domain. The variant retains the potential glycosylation sites relevant to the domains it encompasses.

Comparison Report Between HUMELAM1A_P2 (SEQ ID NO:65) and LEM2_HUMAN (SEQ ID NO:139)

1. An isolated chimeric polypeptide HUMELAM1A_P2 (SEQ ID NO:65), comprising a first amino acid sequence being at least 90% homologous to MIASQFLSALTLVLLIKESGAWSYNTSTEAMTYDEASAYC-QQRYTHLVAIQN KEEIEYLNSILSYSPSYYWI-GIRKVNNVWVWVGTQKPLTEEAKNWAPGEPNN RQKDEDCVEIYIKREKDVGMWNDERC-SKKKLALCYTAACTNTSCSGHGECV ETINNYTCK-CDPGFSGLKCEQ corresponding to amino acids 1-176 of LEM2_HUMAN (SEQ ID NO:139), which also corresponds to amino acids 1-176 of HUMELAM1A_P2 (SEQ ID NO:65), and a second amino acid sequence being at least 70%, optionally at least 80%, preferably at least 85%, more preferably at least 90% and most preferably at least 95% homologous to a polypeptide having the sequence SKSG-SCLFLHLRW (SEQ ID NO:67) corresponding to amino acids 177-189 of HUMELAM1A_P2 (SEQ ID NO:65), wherein said first amino acid sequence and second amino acid sequence are contiguous and in a sequential order.

2. An isolated polypeptide for a tail of HUMELAM1A_P2 (SEQ ID NO:65), comprising a polypeptide being at least 70%, optionally at least about 80%, preferably at least about 85%, more preferably at least about 90% and most preferably at least about 95% homologous to the sequence SKSG-SCLFLHLRW (SEQ ID NO:67) in HUMELAM1A_P2 (SEQ ID NO:65).

Therapeutic Application of the Splice Variant

E-selectin splice variant T1 contains the lectin-like domain and the EGF-like domain. As it lacks the transmembrane domain, it is predicted to be a soluble protein. Mutagenesis studies have shown that the lectin-like domain and the EGF-like domains contain the sites important for ligand binding. Thus, this variant is predicted to serve as an antagonist for E-selectin activity. However, as described above, the presence of the SCR domains elevate the activity of E-selectin constructs. Furthermore, a work by Lo and colleagues have shown that recombinant soluble E-selectin (comprised of the C-lectin, EGF-like and six SCR domains) serves as a chemoattractant for PMN and that immobilization of the recombinant E-selectin result in integrin activation. Taken together, these data demonstrate that the E-selectin variant T1 will be a very weak antagonist for leukocyte-endothelium interaction and might simultaneously serve a weak adhesion molecule if immobilized to the matrix.

Both agonist and antagonist for E-selectin are described in the pharma project. Most antagonists are antibodies and some of them are chemical or synthetic nucleic acid based molecules, which are designed to treat chronic inflammatory diseases and allergies, as well as cancer. The agonist is reported to be on preclinical status for treatment of ischemia.

Thus, the E-selectin variant of the present invention, the polypeptide, HUMELAM1A_P2 (SEQ ID NO:65), the polynucleotide encoding same, HUMELAM1A_T1 (SEQ ID NO:66) and/or the peptide derived from the splice variant of the present invention (SEQ ID NO:67) is an antagonist for leukocyte-endothelium interaction and thereby can be used as a therapeutic agent to treat various disorders such as chronic inflammation (e.g., ischemia-reperfusion, rheumatoid arthritis, asthma, atherosclerosis, and multiple sclerosis), chronic skin diseases (such as atopic dermatitis, psoriasis, allergic contact dermatitis, cutaneous T cell lymphoma).

According to another aspect of the present invention, the E-selectin variant of the present invention, the polypeptide, HUMELAM1A_P2 (SEQ ID NO:65), the polynucleotide encoding same, HUMELAM1A_T1 (SEQ ID NO:66) and/or the peptide derived from the splice variant of the present invention (SEQ ID NO:67) is an antagonist for the E-selectin interaction with carbohydrates and thus can be used as a therapeutic agent to prevent the formation of metastases of several cancer cells (e.g., adenocarcinomas of the colon, pancreas and stomach) and/or prevent the adhesion of human cancer cells to endothelium.

Without being bound to any theory, the E-selectin variant of the present invention, the polypeptide, HUMELAM1A_P2 (SEQ ID NO:65), the polynucleotide encoding same, HUMELAM1A_T1 (SEQ ID NO:66) and/or the peptide derived from the splice variant of the present invention (SEQ ID NO:67) is an E-selectin agonist and thus can be used as a therapeutic agent for the treatment of ischemia.

It will be appreciated that such agent(s) can be administered or provided to an individual in need thereof per se or as part of a pharmaceutical composition with a pharmaceutical acceptable carrier (e.g., PEG and liposomes).

According to another aspect of the present invention, the E-selectin variant of the present invention, the polypeptide, HUMELAM1A_P2 (SEQ ID NO:65), the polynucleotide encoding same, HUMELAM1A_T1 (SEQ ID NO:66) and/or the peptide derived from the splice variant of the present invention (SEQ ID NO:67) are diagnostic marker(s) for chronic inflammatory diseases (e.g., type II diabetes, rheumatoid arthritis, asthma, lupus, sepsis) and cancers (e.g., colorectal and breast cancer).

Diagnosis according to this aspect of the present invention is effected using immunological assays [e.g., Western Blot, immunohistochemistry, FACS analysis, radio immuno assay (RIA), immunofluorescence, and the like using an antibody directed against the HUMELAM1A_P2 (SEQ ID NO:65) variant, or by nucleic acid techniques (NAT) such as RT-PCR, Northern Blot, in situ hybridization, in situ RT-PCR.

Example 18

Splice Variant of Integrin Alpha-L Precursor

Background

Integrin αL (CD11a) forms a heterodimer with integrin β2 (CD18) to generate LFA-1. LFA-1 functions as an intercellular adhesion receptor and as a co-stimulatory and signaling molecule. It mediates the interaction between cytotoxic T cells and their targets, and functions in T and B cells as a mitogen, and in B cells as an inducer of B cell aggregation and Ig production. It interacts with ICAM-1 (CD54), ICAM-2 (CD102), ICAM-3 (CD54), ICAM-4 (Landsteiner-Weiner antigen), or ICAM-5 (telencephalin). High levels of LFA-1 are constitutively expressed on lymphocytes and monocytes, and lower levels on neutrophils. The ability of LFA-1 to interact with its ligands and transmit signals across the plasma membrane is regulated by a variety of extracellular and intracellular factors. These include agents that alter integrin affinity or avidity such as divalent cations $Mg^{2+}$, $Ca^{2+}$, $Mn^{2+}$, the state of cell activation, intracellular $Ca^{2+}$ release, activation of PKC, and ligands themselves. The regulation of LFA-1 activity by these factors avoid inappropriate adhesion while these cells are circulating in blood or migrating in tissues.

Structurally, the extracellular region of LFA-1 contains seven homologues tandem repeats (I-VII) that fold as a β propeller. Domains V-VII contain putative divalent cation binding sites also designated EF-hands. Between repeats II and III there is insertion of ~200 amino acids, known as the I domain, which is considered to be functionally implicated in binding of ligands and cations and contains a discontinued MIDAS. The extracellular portion of integrin αL contains 12 potential N-glycosylation sites and seven disulfide bonds.

Mouse knock out model of integrin αL displays defects in T cell proliferation and cytotoxicity and in tumor rejection but lymphocyte homing, leukocyte extravasation and thymic maturation and selection do not seem to be defected (Cabanas and Sanchez-Madrid, 1999).

Clinical Applications

Inhibition of CD11a, LFA-1, or its ligand have been shown to be a useful target for therapy of several inflammatory situations associated with accumulation of leukocytes leading to clot formation or cytotoxicity. Monoclonal Abs to CD11a, ICAM-1, and CD18 were comparably effective in a rabbit model of myocardial reperfusion injury and reduced infract size by 40-50%, but only if administered well before reperfusion. Reducing cytotoxic T cell activity by mAbs to CD11a/CD18, in combination with standard immunosuppressive therapy, improve the survival of bone marrow transplants in children but not in adults. In a mouse model, anti CD11a mAbs increased the survival of allogenic tumor grafts. LFA-1 might also be involved in cancer metastasis as its expression on hematological tumor cells have been shown to alter metastatic capacity and growth (Mazzone and Richevuti, 1995).

Anti CD11a mAb is a registered drug for treatment of psoriasis (Cabanas and Sanchez-Madrid, 1999 J Biol Regul Homeost Agents 13: 126-129; Mazzone and Richevuti, 1995 Hematologica 80:161-175; Ihanus et al., 2003 Eur J Biochem 270: 1710-1723; McDowell et al., 1998 JBC 273: 27396-27403; Binnerts et al., 1996 JBC 271: 9962-9968.)

Splice Variant Structure

Figure 50:
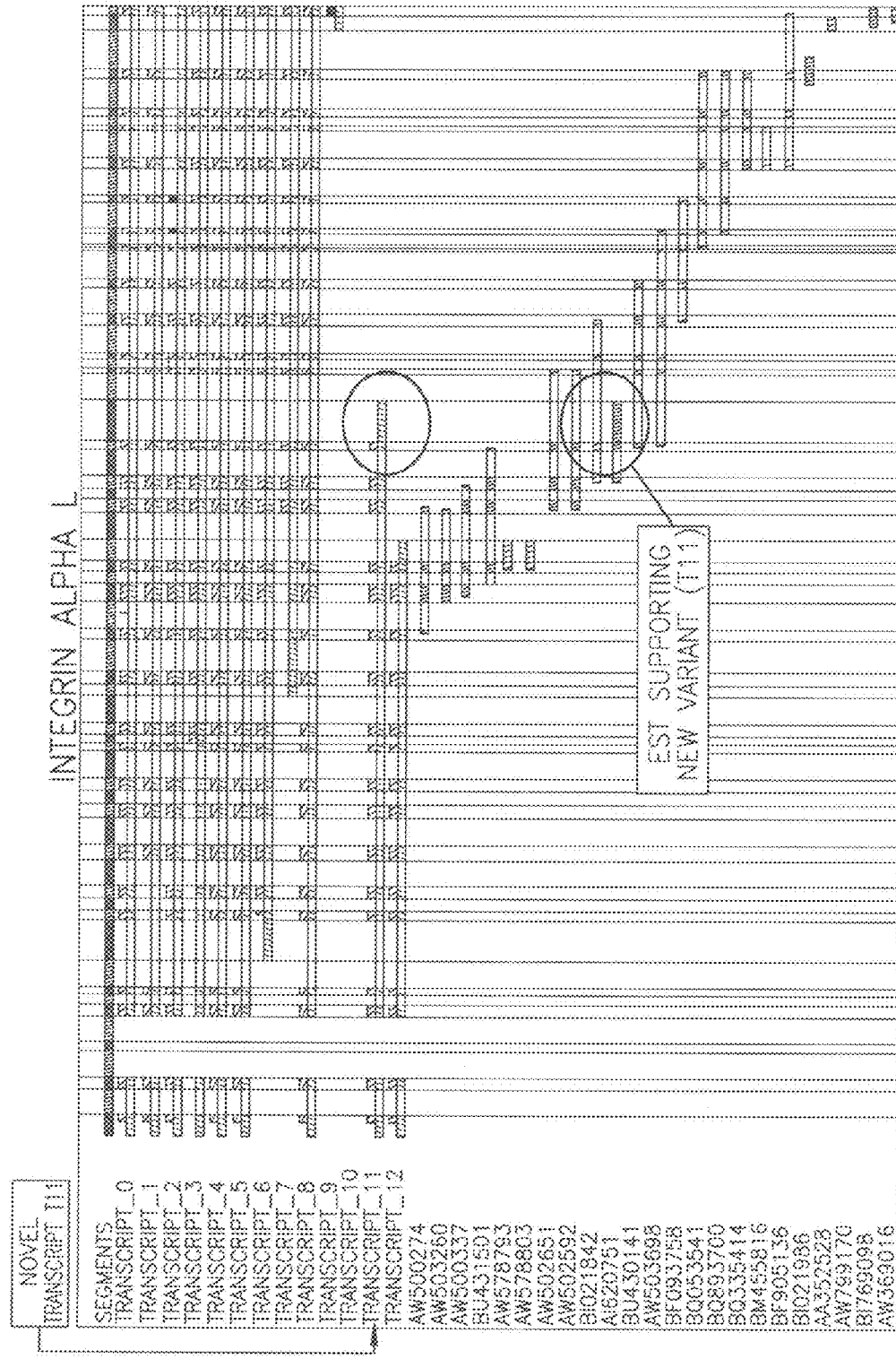
FIG. 50 is a schematic illustration depicting the graphical viewer scheme presenting the new variant of Integrin alpha-L (transcript_T11) as compared to the wild type mRNA. The ESTs supporting the new variant are indicated. Transcript indicated as "0" represents known mRNA. The pattern code is as in FIG. 2.
Figure 52:
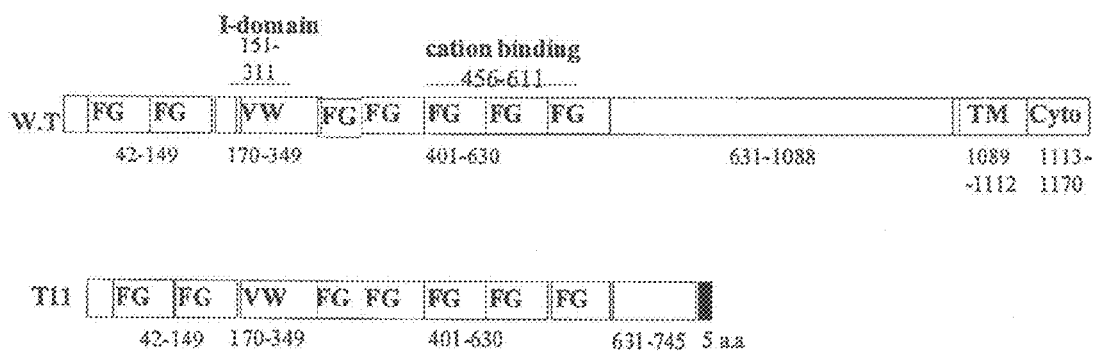
FIG. 52 is a schematic illustration showing the protein domain structure of wild-type Integrin alpha-L (SwissProt locus: ITAL_HUMAN; SEQ ID NO:142) and the variant of the present invention (SEQ ID NO:80). Unique region is indicated (SEQ ID NO: 82).

The present inventors uncovered a novel splice variant of integrin αL (T83460_T11—SEQ ID NO:81; T83460_P8—SEQ ID NO:80; FIGS. 50-51, respectively). The T11 splice variant (T83460_T11) obtained by the alternative splicing of the integrin αL gene result in extension of exon 18 leading to an insertion of a stop codon and the generation of a truncated protein (FIGS. 50-51). This splice variant encodes 750 amino acids long protein (SEQ ID NO:80), which contains 745 amino acids of the wild type sequence, and 5 unique amino acids (VRRDG; SEQ ID NO:82). It encompasses the FG-GAPS I and VII, while lacking the TM and the cytoplasmic domain. It contains seven out of 12 potential N-glycosilation sites and four out of seven disulfide bonds.

Comparison Report Between T83460_P8 (SEQ ID NO:80) and ITAL_HUMAN_V1 (SEQ ID NO:653)

1. An isolated chimeric polypeptide T83460_P8 (SEQ ID NO:80), comprising a first amino acid sequence being at least 90% homologous to MKDSCITVMAMALLSGFFFFA-PASSYNLDVRGARSFSPPRAGRHFGYRVLQV GNGVIVGAPGEGNSTGSLYQCQSGTGH-CLPVTLRGSNYTSKYLGMTLATDPT DGSILACD-PGLSRTCDQNTYLSGLCYLFRQNLQGPM-LQGRPGFQECIKGNVD LVFLFDGSMSLQPDEFQKILDFMKD-VMKKLSNTSYQFAAVQFSTSYKTEFDFS DYVKRKD-PDALLKHVKHMLLLTNTFGAINYVATEV-FREELGARPDATKVLIII TDGEATDSGNIDAAKDIIRYIIGIGKH-FQTKESQETLHKFASKPASEFVKILDTF EKLKDLFTELQKKIYVIEGTSKQDLTS-FNMELSSSGISADLSRGHAVVGAVGA KDWAGGFLD-LKADLQDDTFIGNEPLTPE-VRAGYLGYTVTWLPSRQKTSLLAS GAPRYQHMGRVLLFQEPQGGGH-WSQVQTIHGTQIGSYFGGELCGVDVDQDG ETELLLI-GAPLFYGEQRGGRVFIYQRRQLG-FEEVSELQGDPGYPLGRFGEAITA LTDINGDGLVDVAVGAPLEEQGAVYIFN-GRHGGLSPQPSQRIEGTQVLSGIQW FGRSIH-GVKDLEGDGLADVAVGAESQMIVLSSR-PVVDMVTLMSFSPAEIPVH EVECSYSTSNKMKEGVNITICFQIK-SLIPQFQGRLVANLTYTLQLDGHRTRRRG LFPG-GRHELRRNIAVTTSMSCTDFSFHF-PVCVQDLISPINVSLNFSLWEEEGTP RDQRA corresponding to amino acids 1-745 of ITAL_HUMAN_V1 (SEQ ID NO:653), which also corresponds to amino acids 1-745 of T83460_P8 (SEQ ID NO:80), and a second amino acid sequence being at least 70%, optionally at least 80%, preferably at least 85%, more preferably at least 90% and most preferably at least 95% homologous to a polypeptide having the sequence VRRDG (SEQ ID NO:82) corresponding to amino acids 746-750 of T83460_P8 (SEQ ID NO:80), wherein said first amino acid sequence and second amino acid sequence are contiguous and in a sequential order.

2. An isolated polypeptide for a tail of T83460_P8 (SEQ ID NO:80), comprising a polypeptide being at least 70%, optionally at least about 80%, preferably at least about 85%, more preferably at least about 90% and most preferably at least about 95% homologous to the sequence VRRDG (SEQ ID NO:82) in T83460_P8 (SEQ ID NO:80).

Comparison Report Between T83460_P8 (SEQ ID NO:80) and ITAL_HUMAN (SEQ ID NO:142)

1. An isolated chimeric polypeptide T83460_P8 (SEQ ID NO:80), comprising a first amino acid sequence being at least 90% homologous to MKDSCITVMAMALLSGFFFFA-PASSYNLDVRGARSFSPPRAGRHFGYRVLQV GNGVIVGAPGEGNSTGSLYQCQSGTGH-CLPVTLRGSNYTSKYLGMTLATDPT DGSILACD-PGLSRTCDQNTYLSGLCYLFRQNLQGPM-LQGRPGFQECIKGNVD LVFLFDGSMSLQPDEFQKILDFMKD-VMKKLSNTSYQFAAVQFSTSYKTEFDFS DYVKRKD-PDALLKHVKHMLLLTNTFGAINYVATEV-FREELGARPDATKVLIII TDGEATDSGNIDAAKDIIRYIIGIGKH-FQTKESQETLHKFASKPASEFVKILDTF EKLKDLFTELQKKIYVIEGTSKQDLTS-FNMELSSSGISADLSRGHAVVGAVGA KDWAGGFLD-LKADLQDDTFIGNEPLTPE-VRAGYLGYTVTWLPSRQKTSLLAS GAPRYQHMGRVLLFQEPQGGGH-WSQVQTIHGTQIGSYFGGELCGVDVDQDG ETELLLI-GAPLFYGEQRGGRVFIYQRRQLG-FEEVSELQGDPGYPLGRFGEAITA LTDINGDGLVDVAVGAPLEEQGAVYIFN-GRHGGLSPQPSQRIEGTQVLSGIQW FGRSIH-GVKDLEGDGLADVAVGAESQMIVLSSR-PVVDMVTLMSFSPAEIPVH EVECSYSTSNKMKEGVNITICFQIKSL corresponding to amino acids 1-659 of ITAL_HUMAN (SEQ ID NO:142), which also corresponds to amino acids 1-659 of T83460_P8 (SEQ ID NO:80), a bridging amino acid I corresponding to amino acid 660 of T83460_P8 (SEQ ID NO:80), a second amino acid sequence being at least 90% homologous to PQFQGRLVANLTYTLQLDGHRTRRRGLF-PGGRHELRRNIAVTTSMSCTDFSFH FPVCVQDLISP-INVSLNFSLWEEEGTPRDQRA corresponding to amino acids 661-745 of ITAL_HUMAN (SEQ ID NO:142), which also corresponds to amino acids 661-745 of T83460_P8 (SEQ ID NO:80), and a third amino acid sequence being at least 70%, optionally at least 80%, preferably at least 85%, more preferably at least 90% and most preferably at least 95% homologous to a polypeptide having the sequence VRRDG (SEQ ID NO:82) corresponding to amino acids 746-750 of T83460_P8 (SEQ ID NO:80), wherein said first amino acid sequence, bridging amino acid, second amino acid sequence and third amino acid sequence are contiguous and in a sequential order.

2. An isolated polypeptide for a tail of T83460_P8 (SEQ ID NO:80), comprising a polypeptide being at least 70%, optionally at least about 80%, preferably at least about 85%, more preferably at least about 90% and most preferably at least about 95% homologous to the sequence VRRDG (SEQ ID NO:82) in T83460_P8 (SEQ ID NO:80).

Therapeutic Applications of the Variant

Immobilized recombinant CD11a I-domain fused to GST was shown to bind ICAM-4 positive cells (Ihanus et al., 2003). In addition, McDowell et al. have shown that recombinant soluble form of CD11a I domain inhibits the binding of Mg²⁺ activated T cells (high affinity binding) but not phorbol ester-activated T cells (low affinity) to ICAM-1. The conclusion drown from this study suggests that the I domain is involved in a conformational change which is necessary for binding activity and that soluble I domain (or its fragments) interferes with interdomain alterations or intersubunit associations and thereby prevent changes in the quarternary structure of LFA-1. Accordingly, T11, which encompass the whole I domain as well as the MIDAS, is predicted to function as an antagonist of LFA-1 activity and to inhibit leukocyte adhesion to LFA-1 substrates. As the I domains for different ligands are overlapping but not identical (Ihanus et al., 2003), the antagonistic activity of T11 will probably be non-ligand specific.

Thus, a soluble αL variant, i.e., a polypeptide homologous to SEQ ID NO:80, a polynucleotide homologous to SEQ ID NO:81, and/or a peptide homologous to SEQ ID NO:82 is an antagonist of LFA-1 activity.

Thus, the present inventors uncovered a therapeutic agent which can be used to: (i) inhibit leukocyte adhesion to LFA-1 substrates, (ii) prevent the interaction between cytotoxic T cell and their targets, (iii) inhibit leukocyte accumulation associated with inflammation. Such an agent can be used (i) in the treatment of reperfusion injury, (ii) as an immunosuppressant (by reducing cytotoxic T cell activity) in transplantations, (iii) in the treatment of psoriasis. Such an agent is a polypeptide homologous to SEQ ID NO:80, and/or a polynucleotide homologous to SEQ ID NO:81 and/or a peptide homologous to SEQ ID NO:82.

Example 19

Splice Variant of Macrophage Inflammatory Protein-2-Beta Precursor

Background

The macrophage inflammatory protein-2-beta precursor (MIP2-beta; CXCL3; Growth regulated protein gamma; GRO-gamma; GRO3; GROG; SCYB3) is a secreted protein exhibiting chemokine activity for neutrophils. MIP2-β may have a role in inflammation and immune response and exerts its effects on endothelial cells in an autocrine fashion. In vitro studies showed that a processed polypeptide having amino acids 5-73 of the WT protein (GenBank Accession NO. P19876) exhibits a 5-fold higher chemotactic activity for neutrophilic granulocytes, suggesting a functional role for this part of the protein.

MIP2-β is overexpressed in lung and can be used as a marker for proliferation of this tissue or as a marker for pathological de-differentiation of this tissue or tissue damage.

Splice Variant T11329_T1 (SEQ ID NO:191) Encodes a New Secreted Form of the MIP2-β, T11329_P2 (SEQ ID NO:192)

The present inventors have uncovered a new MIP2-β variant [T11329_T1-SEQ ID NO:191; T11329_P2—SEQ ID NO:1921. The protein coordinates on the transcript start from nucleotide 84 and end at nucleotide 614 as set forth in SEQ ID NO:191 (T11329_T1 transcript).

Alignment of the new MIP2-β variant (T11329_P2—SEQ ID NO:192) with the WT protein (GenBank Accession No. P19876; SEQ ID NO:193) revealed that the new variant includes additional 103 amino acids [MHKKGSPILGSH-TARVAGTSPPALPLLAQLPDASAEPHG-PRHALRRPQQS PAPAGGAAAPAPGGRQPARSRWV-PAPWGPRAGRGWGGRPAPTAPLNQRVY SSL (SEQ ID NO:88), FIG. 109] followed by amino acids 34-107 of the WT protein (SEQ ID NO:193). The new variant uncovered by the present invention lacks the signal peptide of the WT protein (amino acids 1-35 of GenBank Accession No. P19876) and the IPR001089 Small chemokine, C-X-C subfamily IPR002473 Small chemokine, and C-X-C/Interleukin 8.

Comparison Report Between T11329_P2 (SEQ ID NO:192) and MI2B_HUMAN (SEQ ID NO:193)

1. An isolated chimeric polypeptide T11329_P2 (SEQ ID NO:192), comprising a first amino acid sequence being at least 70%, optionally at least 80%, preferably at least 85%, more preferably at least 90% and most preferably at least 95% homologous to a polypeptide having the sequence MHKKG-SPILGSHTARVAGTSPPALPLLAQLPDA-SAEPHGPRHALRRPQQSPAP AGGAAAPAPGGRQ-PARSRWVPAPWGPRAGRGWGGRPAPTAPLNQRVYSSL (SEQ ID NO:88) corresponding to amino acids 1-103 of T11329_P2 (SEQ ID NO:192), and a second amino acid sequence being at least 90% homologous to GASVVTEL-RCQCLQTLQGIHLKNIQSVNVRSPGPH-CAQTEVIATLKNGKKACL NPASPMVQKIIEKILNKG-STN corresponding to amino acids 34-107 of MI2B_HUMAN (SEQ ID NO:193), which also corresponds to amino acids 104-177 of T11329_P2 (SEQ ID NO:192), wherein said first amino acid sequence and second amino acid sequence are contiguous and in a sequential order.

2. An isolated polypeptide for a head of T11329_P2 (SEQ ID NO:192), comprising a polypeptide being at least 70%, optionally at least about 80%, preferably at least about 85%, more preferably at least about 90% and most preferably at least about 95% homologous to the sequence MHKKG-SPILGSHTARVAGTSPPALPLLAQLPDA-SAEPHGPRHALRRPQQSPAP AGGAAAPAPGGRQ-PARSRWVPAPWGPRAGRGWGGRPAPTAPLNQRVYS SL (SEQ ID NO:88) of T11329_P2 (SEQ ID NO:192).

These results suggest the use of the new MIP2-13 variant of the present invention (T11329_P2—SEQ ID NO:192), the polynucleotide encoding same (T11329_T1 transcript—SEQ ID NO:191) as a diagnostic marker for lung cell proliferation or de-differentiation, as well as lung cancer. Diagnosis according to this aspect of the present invention is effected using immunological assays [e.g., Western Blot, immunohistochemistry, FACS analysis, radio immuno assay (RIA), immunofluorescence, and the like using an antibody directed against the MIP2-β variant (T11329_P2—SEQ ID NO:192)], or by nucleic acid techniques (NAT) such as RT-PCR, Northern Blot, in situ hybridization, in situ RT-PCR.

Example 20

Splice Variant of Integrin Beta-7 Precursor

Background

The β7 integrin subfamily has two known members: α4β7 and αEβ7, both of which are involved in localization of leukocytes to mucosal sites.

In the adult, elevated levels of α4β7 are expressed on activated T and B cells. The preferential ligand for integrin α4β7 is MAdCAM-1, which is expressed on the mucosal endothelium of Peyer's patchs, mesenteric lymph nodes, and within the lamina propria of the small and large intestine. α4β7 also interacts with VCAM-1 and with the CS-1 region of fibronectin although both these interactions are of a much lower affinity than the α4β7/MAdCAM-1 interaction (Viney and Fong, 1998).

The affinity/avidity of α4β7 for MAdCAM-1 can be increased several fold upon activation of the leukocyte. This is achieved by conformational changes in the extracellular domains of the receptor and can be influenced by changes in the cytoplasmic domain of β7 (Viney and Fong 1998).

Integrin αEβ7 mediates interaction of T cells with epithelial cells at mucosal surfaces via recognition of E-cadherin. Interaction of αEβ7 with E-cadherin mediates retention, migration and proliferation of intraepithelial T cells (Viney and Fong 1998).

The ligand binding activity of β7 has been mapped to an inserted sequence that has a high homology with the A-domain (also referred to as I-domain) of the von Willebrand factor. This von Willebrand-like domain resides within the extracellular portion of β7, and is common to all β subunits. Together with conserved downstream residues, the von Willebrand-like domain could form a complete metal-ion-dependent adhesion site (MIDAS) (Higgins et al., 2000). The MIDAS accounts for ligand binding as well as ligand specificity and probably involves in the association with the α subunit. Structure-function studies revealed that the ion binding activity resides within amino acids 150-172 of the MIDAS and that binding of $Mn^{2+}$ or $Mg^{2+}$ to this site induces a conformational change that is critical for ligand binding (Tidswell et al., 1997). Downstream to the von Willebrand-like domain there are four cystein rich domains, which are also thought to be involved in ligand binding. These are followed by a transmembrane domain and a short, signaling, cytoplasmic domain.

Clinical Applications

Elevated expression of MAdCAM-1 is described in intestinal inflammation in mouse models of experimentally induced and spontaneous colitis. This increase in MAdCAM-1 expression appears to be associated with increased cellular infiltrates. Thus, disruption of the leukocyte receptor interaction with MAdCAM-1 might selectively attenuate trafficking to the intestine during inflammation. Since MAdCAM-1 has a rather restricted tissue expression, selectively blocking the interaction between MAdCAM-1 and α4β7 might be therapeutically beneficial for treating inflammation in the intestine without dramatically affecting immune regulation and trafficking elsewhere in the body. Indeed, neutralizing mAbs to α4β7 and MAdCAM-1 has both been shown to be useful in attenuating inflammation in experimental models of colitis. Furthermore, administration of antibodies to either α4β7 or αEβ7 reduced intestinal inflammation in GVH disease. αEβ7 is likely to have an additional role in rejection of epithelial tissue within allografts (Higgins et al., 2000). Antagonistic mAbs for α4β7 are in phase II of clinical trials for intestinal inflammation associated with colitis, Crohn's disease, and irritable bowel syndrome.

Splice Variant Structure

Figure 58:
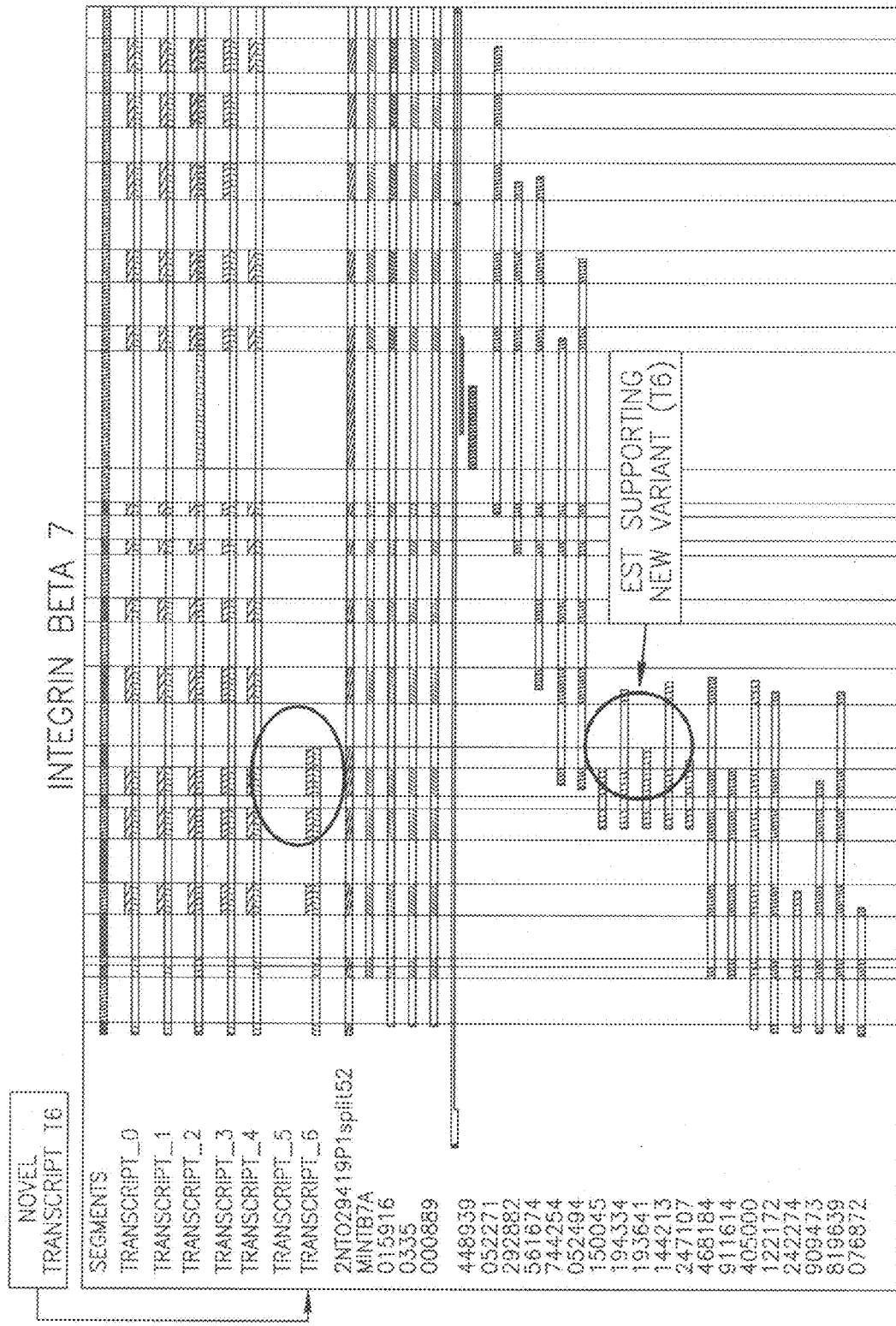
FIG. 58 is a schematic illustration depicting the graphical viewer scheme presenting the new variant of Integrin beta-7 (transcript_T6) as compared to the wild type mRNA. The ESTs supporting the new variant are indicated. Transcript indicated as "0" represents known mRNA. The pattern code is as in FIG. 2.
Figure 60:
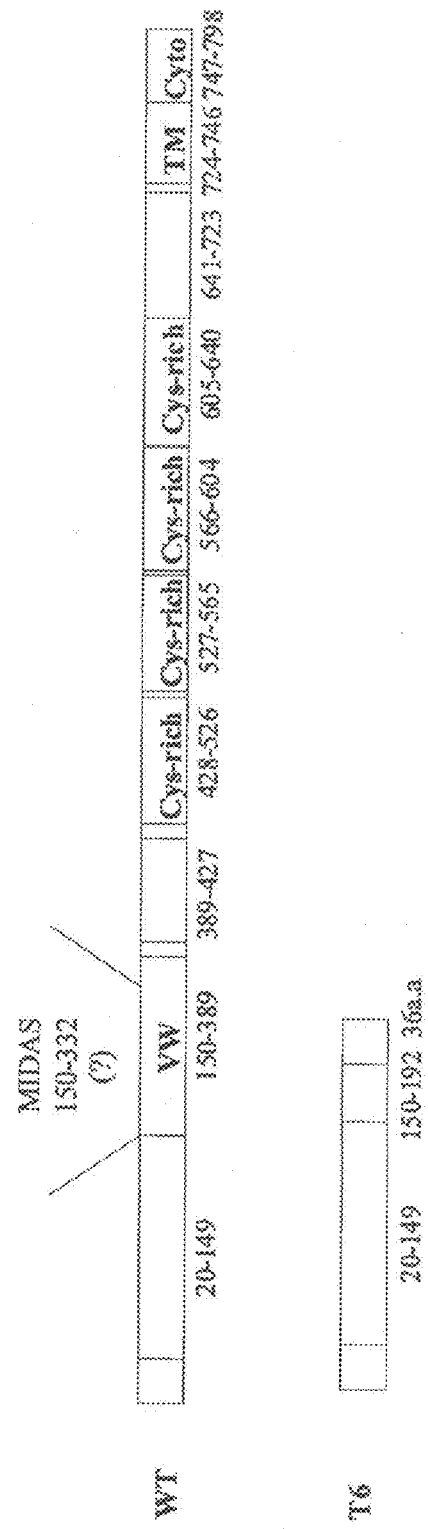
FIG. 60 is a schematic illustration showing the protein domain structure of wild-type Integrin beta-7 (SwissProt locus: ITB7_HUMAN; SEQ ID NO:144) and the variant of the present invention (SEQ ID NO:89). Unique region is indicated (SEQ ID NO:91).
Figure 62:
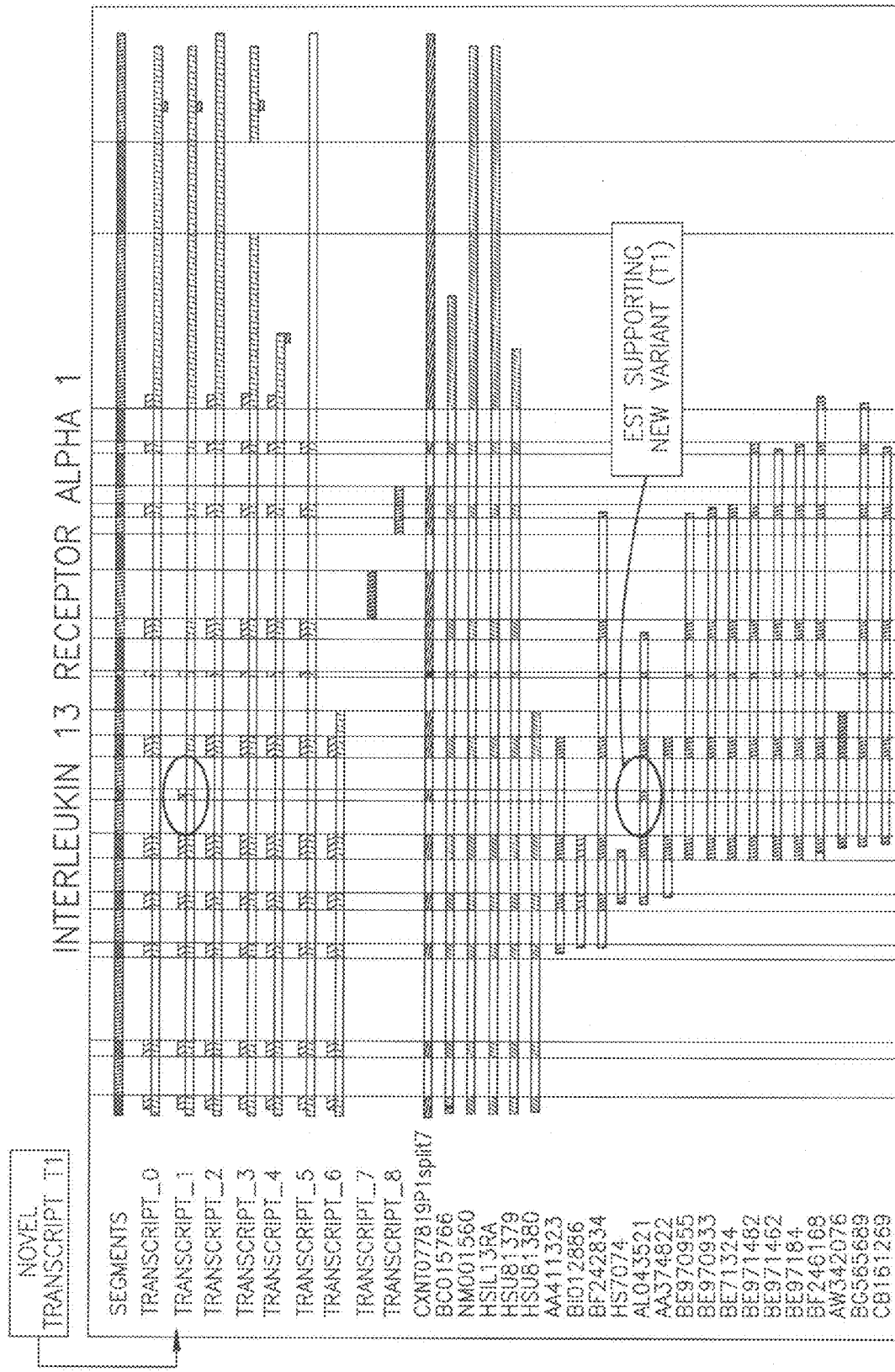
FIG. 62 is a schematic illustration depicting the graphical viewer scheme presenting the new variant of Interleukin 13 receptor alpha-1 (transcript_T1 as compared to the wild type mRNA. The ESTs supporting the new variant are indicated. Transcript indicated as "0" represents known mRNA. The pattern code is as in FIG. 2.
Figure 64:
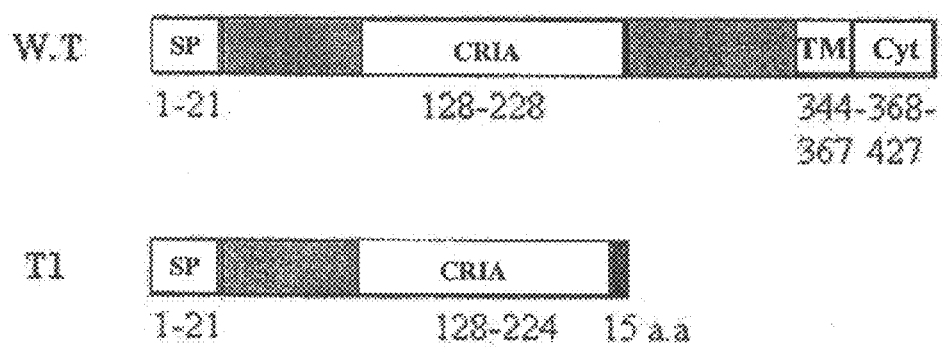
FIG. 64 is a schematic illustration showing the protein domain structure of wild-type Interleukin 13 receptor alpha-1 (SwissProt locus: I131_HUMAN; SEQ ID NO:145) and the variant of the present invention (SEQ ID NO:92). Unique region is indicated (SEQ ID NO:94).

The present inventors uncovered a novel splice variant of integrin β7 (S80335_T6-SEQ ID NO:90; S80335_P5—SEQ ID NO:89; FIGS. 57*a-b*). The T6 splice variant obtained by the alternative splicing of the integrin β7 gene result from extension of exon 5 leading to an insertion of a stop codon and the generation of a truncated protein (FIGS. 58-60). This variant encodes 228 amino acids long protein, which contains 192 amino acids of the wild type (ITB7_HUMAN; SEQ ID NO:144) sequence and 36 unique amino acids (EPSAASRPVSPCLFNHCPSLCQHPGLTRAPTCPPSC SEQ ID NO:91). It encompasses about one fifth of the von Willebrand and lacks all the downstream domains.

Comparison Report Between S80335_P5 (SEQ ID NO:89) and ITB7_HUMAN (SEQ ID NO:144)

1. An isolated chimeric polypeptide S80335_P5 (SEQ ID NO:89), comprising a first amino acid sequence being at least 90% homologous to MVALPMVLVLLLVLSRGE-SELDAKIPSTGDATEWRNPHLSMLGSCQPAPSCQ KCILSHPSCAWCKQLNFTASGEAEARR-CARREELLARGCPLEELEEPRGQQEV LQDQPLSQ-GARGEGATQLAPQRVRVTLR-PGEPQQLQVRFLRAEGYPVDLYYL MDLSYSMKDDLERVRQLGHALLVRLQEVTHSVRIG corresponding to amino acids 1-192 of ITB7_HUMAN (SEQ ID NO:144), which also corresponds to amino acids 1-192 of S80335_P5 (SEQ ID NO:89), and a second amino acid sequence being at least 70%, optionally at least 80%, preferably at least 85%, more preferably at least 90% and most preferably at least 95% homologous to a polypeptide having the sequence EPSAASRPVSPCLFNHCPSLCQHPGL-TRAPTCPPSC (SEQ ID NO:91) corresponding to amino acids 193-228 of S80335_P5 (SEQ ID NO:89), wherein said first amino acid sequence and second amino acid sequence are contiguous and in a sequential order.

2. An isolated polypeptide for a tail of S80335_P5 (SEQ ID NO:89), comprising a polypeptide being at least 70%, optionally at least about 80%, preferably at least about 85%, more preferably at least about 90% and most preferably at least about 95% homologous to the sequence EPSAASRPVSP-CLFNHCPSLCQHPGLTRAPTCPPSC (SEQ ID NO:91) in S80335_P5 (SEQ ID NO:89).

Therapeutic Application of the Variant

Variant T6 (S80335_P5) is a truncated protein that lacks the TM and the cytoplasmic domain. It is predicted to be a soluble protein and might bind divalent cations. This might result in conformational change and subsequent ligand binding leading to blockage of the interaction between the β7 integrins (α4β7 or αEβ7) and their ligands (MAdCAM-1 and E-cadherin, respectively). However, it is not clear whether ligand could be bound by a non-heterodimeric protein, nonetheless a truncated protein that encompasses only a small part of the von Willebrand domain.

Thus, the integrin β7 variant of the present invention, can be an antagonist of the β7 integrin receptors (e.g., α4β7 or αEβ7) and as such it can be used to prevent the interaction with MAdCAM-1.

The present inventors uncovered a therapeutic agent which can be used to: prevent and/or treat intestinal inflammation (e.g., colitis, GVH disease, Crohn's disease, and irritable bowel syndrome). Such an agent is a polypeptide homologous to the SEQ ID NO:89, and/or a polynucleotide homologous to SEQ ID NO:90, and/or a peptide homologous to SEQ ID NO:91. It will be appreciated that such an agent can be administered or provided to an individual in need thereof per se, or as part of a pharmaceutical composition with a pharmaceutically acceptable carrier (e.g., PEG or liposomes).

Example 21

Splice Variant of Complement C5

Background

Complement is a dynamic self-assembling system of plasma proteins, which constitute a part of the humoral defense system against bacteria and viral pathogens. The fifth component of the complement, C5, is of particular interest since, upon activation, it participates in both cytolytic and inflammatory processes.

C5 is a member of a structural homologous family of proteins, which includes the complement proteins C3 and C4, as well as α2-macroglobulin. Biosynthesis of C5 occurs in hepatocytes, macrophages, fibroblasts, type II alveolar epithelial cells, lung, spleen, and fetal intestine as an intracellular precursor, pro-C5. Pro-C5 is processed, glycosylated, and secreted to the serum as a 190,000 Da glycoprotein composed of disulfate-linked α- and β-chains designated CS.

Activation of the complement system by antigen-antibody complexes (classical pathway), or polysaccharides/microbial surfaces (alternative pathway), initiates a cascade of proteolytic events in which the two chain-CS component is cleaved by C5 convertase. This cleavage occurs on Arg733 of the amino-terminus of the α-chain, and yields the C5a and C5b. C5a is a powerful, 74 amino acid, peptide-mediator of inflammation with anaphylotoxic activity. It elicits its activity via binding to the 7-transmembrane, GPCR, C5a receptor (C5aR), expressed on cells of myeloid origin (neutrophils, eosenophils, and basophils, macrophages and monocytes), epithelial cells, smooth muscle cells and on activated B and T cells. C5aR activation with sub-nanomolar levels of C5a result in chemotaxis of all myeloid lineages, while higher nanomolar concentrations elicit degranulation and activation of NADPH oxidase.

C5b triggers the formation of the membrane-attack complex that can damage certain pathogens. C5b initiates the assembly of the downstream complement components and their insertion into the cell membrane. This process begins with the binding of one C5b molecule to C6. The C5b,6 complex then binds one molecule of C7. This reaction leads to a conformational change in the constituent molecules, with the exposure of a hydrophobic site on C7, which inserts into the lipid bilayer. Similar hydrophobic sites are exposed on the later components, C8 and C9, when they are bound to the complex, allowing these proteins also to insert into the lipid bilayer.

Clinical Applications

Activation of the complement system via either the classical or the alternative pathway results in the generation of C5a and C5b. C5a acts as a very potent anaphylatoxin and can induce human polymorphonuclear leukocytes to migrate in a directed fashion, to degranulate, to undergo a burst of oxidative metabolism, and to aggregate. The in vivo effect of C5a depends on its site of generation: intravascular release of C5a in the general circulation leads to adult respiratory distress syndrome, while its release in tissue spaces result in local inflammatory reaction. Local generation of neutrophil chemoattractants, including C5a, resulting in neutrophil accumulation, was described in chronic obstructive pulmonary disease (COPD) and in inflammatory responses that result from ischemia in myocardial tissues. Expression of the activating and regulatory proteins of the complement, as well as the C3a/C5a receptors, was also reported in the CNS. Recently, complement activation was shown to account for multiple sclerosis and for Alzheimer disease. Excessive complement activation can also lead to tissue injury that mimics that seen in autoimmune disorders. Accordingly, regulation of C5a receptor was shown to be involved in Arthritis. Excessive C5b and C5a activity has also been associated with renal disease and their regulation is important to avoid hemodialysis and ongoing glumerular diseases.

The only CS-related inherited deficiency described to date is Neisseria. Neisseria is associated with increased susceptibility to infection and involves acute bacterial diseases and meningitis. Complement agonist for treating Neisseria has not been described, probably regarding the hazardous potential of such molecules.

Inhibitors for CS designed to serve as anti-inflammatory and neuroprotective agent, and for treatment of adult respiratory distress, cardiovascular reperfusion injury, arthritis, and for urological use, are at phase II of clinical trials.

Additional references which are fully incorporated herein: Haviland et al., 1991. JBC 226: 11818-11825; Pellas et al., 1999. Current Pharmaceutical Design 5:737-755; Gerard et al., 1994. Annu Rev Immunol 12:775-808; That et al., 2003. JI 171:6565-6573; Sandoval et al., 2000. JI 165:1066-1073; Low et al., 1999, JI 162:6580-6588; Vogt, 1986, Complement 3:177-188; Perez, 1984 Crit. Rev Oncol Hematol 1:199-225; Guenther, 1983 J Am Acad Dermatol 9:815-839; Williams et al., 2001, Navartis Found Sypm 234:141-148; Shen et al., 2003, Prog Neurobiol 70:463-472; Barnum, 2002, Immunol Res 26:7-13; Williams, 1996, Pharmacol Ther 72: 1-12; Ito et al., 1990, Blood Cells 145-166; Till et al., 1983, Agents Actions Suppl 12:383-396; Barger, 1990, Rev Infect Dis 4: S401-409; Tsokos et al., 2004, Curr Dir autoimmun 7:149-164; Johnson, 1997, Curr Opin Nephrol Hypertens 6:120-127).

Splice Variants Structure

The present inventors uncovered two novel splice variants of Complement component C5 (SEQ ID NOs:101, 102, 104 and 105; FIGS. 69a-d).

Figure 70B:
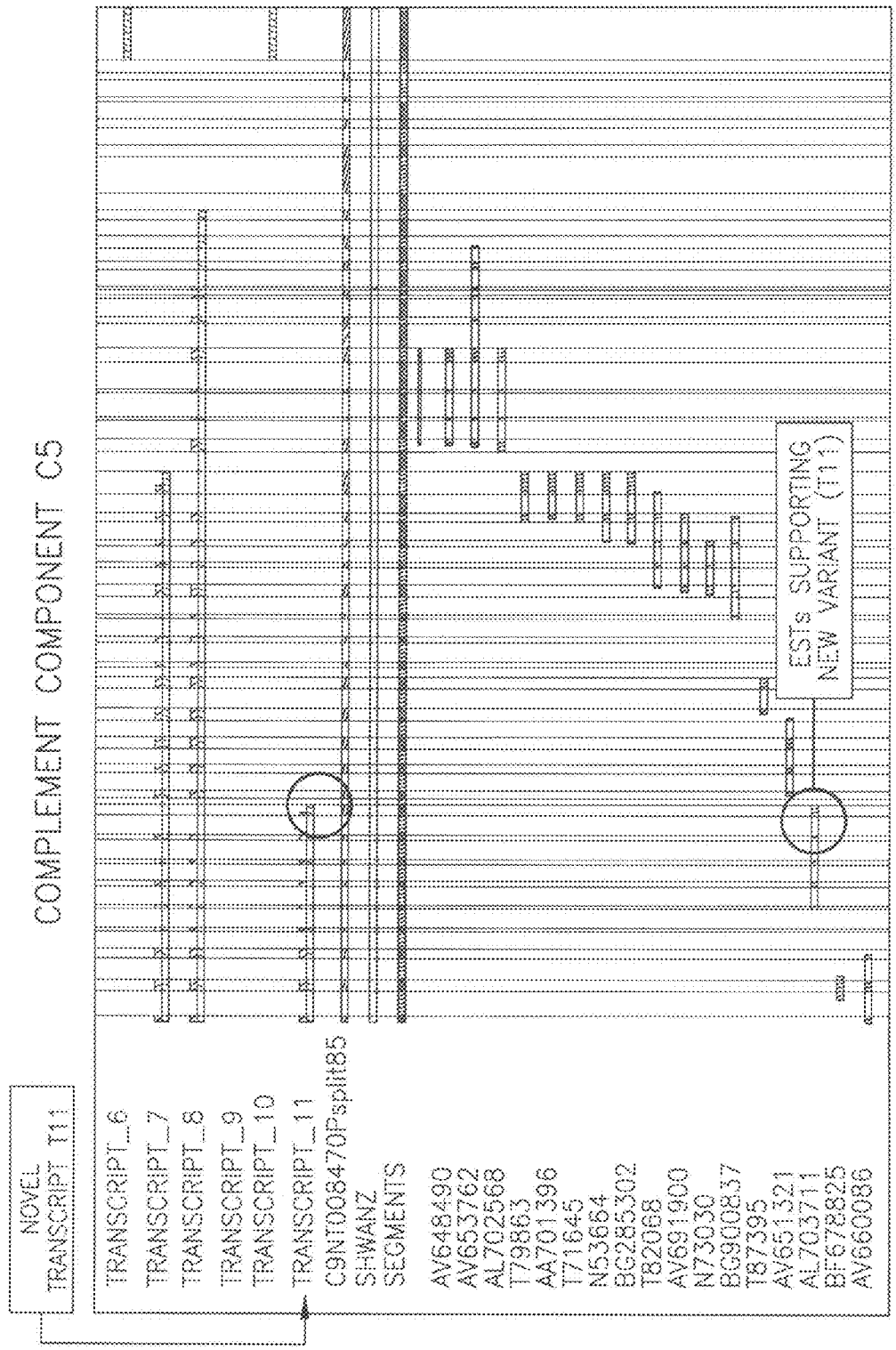

The C5 splice variant T7 (transcript: HUMC5_T7—SEQ ID NO:102; polypeptide: HUMC5_P6—SEQ ID NO:101; FIGS. 69a and b, respectively) results from the alternative splicing of the C5 gene, thus introducing a new exon (exon 20A), leading to insertion of a stop codon and the generation of a truncated protein (FIGS. 70, 71a, 72). C5 T7 contains 854 amino acids of the wild type C5 (CO5_HUMAN; SEQ ID NO:147) and a unique sequence of 48 amino acids at the C-terminus (SLALSPRLECNGKISGQLQVRLPGSSD-SPASASQVAGITGTHHHAQPT; SEQ ID NO:103). It contains an intact β-chain comprised of the α2-macroglobulin domain, and a truncated α-chain containing the anaphylotoxin-like domain and lacks most of the α2-macroglobulin and the NTR (Netrin domain).

Comparison Report Between HUMC5_P6 (SEQ ID NO:101) and CO5_HUMAN_V1 (SEQ ID NO:652)

1. An isolated chimeric polypeptide HUMC5_P6 (SEQ ID NO:101), comprising a first amino acid sequence being at least 90% homologous to MGLLGILCFLIFLGKTWGQEQ-TYVISAPKIPRVGASENIVIQVYGYTEAFDATIS IKSYPDKKFSYSSGHVHLSSENKFQN-SAILTIQPKQLPGGQNPVSYVYLEVVSK HFSKSKRM-PITYDNGFLFIHTDKPVYTPDQS-VKVRVYSLNDDLKPAKRETVLT FIDPEGSEVDMVEEIDHIGIISFPD-FKIPSNPRYGMWTIKAKYKEDFSTTGTAYF EVKEYV-LPHFSVSIEPEYNFIGYKNFKNPEI-TIKARYFYNKVVTEADVYITFGIR EDLKDDQKEMMQTAMQNTMLINGIAQVT-FDSETAVKELSYYSLEDLNNKYL YIAVTVIESTGGF-SEEAEIPGIKYVLSPYKLNLVATPLFLK-PGIPYPIKVQVKDS LDQLVGGVPV corresponding to amino acids 1-388 of CO5_HUMAN_V1 (SEQ ID NO:652), which also corresponds to amino acids 1-388 of HUMC5_P6 (SEQ ID NO:101), a bridging amino acid T corresponding to amino acid 389 of HUMC5_P6 (SEQ ID NO:101), a second amino acid sequence being at least 90% homologous to LNAQTIDVNQETSDLDPSKS-VTRVDDGVASFVLNLPSGVTVLEFNVKTDAPD LPEENQAREGYRAIAYSSLSQSYLYID-WTDNHKALLVGEHLNIIVTPKSPYIDK ITHYNYLIL-SKGKIIHFGTREKFS-DASYQSINIPVTQNMVPSSRLLVYYIVTGEQ TAELVSDSVWLNIEEKCGNQLQVHLSP-DADAYSPGQTVSLNMATGMDSWVA LAAVD-SAVYGVQRGAKKPLERVFQFLEKSDLGC-GAGGGLNNANVFHLAGLT FLTNANADDSQENDEPCKEILR-PRRTLQKKIEEIAAKYKHSVVKKCCYDGAC VNNDE- TCEQRAARISLGPRCIKAFTECCV-
VASQLRANISHKDMQLGRLHMKT
LLPVSKPEIRSYFPESWLW-
EVHLVPRRKQLQFALPDSLTTWEIQGVGISNTGIC
VADTVKAKVFKDVFLEMNIPYSVVRGE-
QIQLKGTVYNYRTSGMQ corresponding to amino acids 390-854 of CO5_HUMAN_V1 (SEQ ID NO:652), which also corresponds to amino acids 390-854 of HUMC5_P6 (SEQ ID NO:101), and a third amino acid sequence being at least 70%, optionally at least 80%, preferably at least 85%, more preferably at least 90% and most preferably at least 95% homologous to a polypeptide having the sequence SLAL-SPRLECNGKISGQLQVRLPGSSD-SPASASQVAGITGTHHHAQPT (SEQ ID NO:103) corresponding to amino acids 855-902 of HUMC5_P6 (SEQ ID NO:101), wherein said first amino acid sequence, bridging amino acid, second amino acid sequence and third amino acid sequence are contiguous and in a sequential order.

2. An isolated polypeptide for a tail of HUMC5_P6 (SEQ ID NO:101), comprising a polypeptide being at least 70%, optionally at least about 80%, preferably at least about 85%, more preferably at least about 90% and most preferably at least about 95% homologous to the sequence SLAL-SPRLECNGKISGQLQVRLPGSSD-SPASASQVAGITGTHHHAQPT (SEQ ID NO:103) in HUMC5_P6 (SEQ ID NO:101).

Comparison Report Between HUMC5_P6 (SEQ ID NO:101) and CO5_HUMAN (SEQ ID NO:147)

1. An isolated chimeric polypeptide HUMC5_P6 (SEQ ID NO:101), comprising a first amino acid sequence being at least 90% homologous to MGLLGILCFLIFLGKTWGQEQ-TYVISAPKIPRVGASENIVIQVYGYTEAFDATIS IKSYPDKKFSYSSGHVHLSSENKFQN-SAILTIQPKQLPGGQNPVSYVYLEVVSK HFSKSKRM-PITYDNGFLFIHTDKPVYTPDQS-VKVRVYSLNDDLKPAKRETVLT FIDPEGSEVDMVEEIDHIGIISFPD-FKIPSNPRYGMWTIKAKYKEDFSTTGTAYF EVKEYV-LPHFSVSIEPEYNFIGYKNFKNFEI-TIKARYFYNKVVTEADVYITFGIR EDLKDDQKEMMQTAMQNTMLINGIAQVT-FDSETAVKELSYYSLEDLNNKYL YIAVTVIESTGGF-SEEAEIPGIKYVLSPYKLNLVATPLFLK-PGIPYPIKVQVKDS LDQLVGGVPV corresponding to amino acids 1-388 of CO5_HUMAN (SEQ ID NO:147), which also corresponds to amino acids 1-388 of HUMC5_P6 (SEQ ID NO:101), a bridging amino acid T corresponding to amino acid 389 of HUMC5_P6 (SEQ ID NO:101), a second amino acid sequence being at least 90% homologous to LNAQTIDVNQETSDLDPSKS-VTRVDDGVASFVLNLPSGVTVLEFNVKTDAPD LPEENQAREGYRAIAYSSLSQSYLYID-WTDNHKALLVGEHLNIIVTPKSPYIDK ITHYNYLIL-SKGKIIHFGTREKFS-DASYQSINIPVTQNMVPSSRLLVYYIVTGEQ TAELVSDSVWLNIEEKCGNQLQVHLSP-DADAYSPGQTVSLNMATGMDSWVA LAAVD-SAVYGVQRGAKKPLERVFQFLEKSDLGC-GAGGGLNNANVFHLAGLT FLTNANADDSQENDEPCKEILR-PRRTLQKKIEEIAAKYKHSVVKKCCYDGAC VNNDE-TCEQRAARISLGPRCIKAFTECCV-VASQLRANISHKDMQLGRLHMKT LLPVSKPEIRSYFPESWLW-EVHLVPRRKQLQFALPDSLTTWEIQG corresponding to amino acids 390-801 of CO5_HUMAN (SEQ ID NO:147), which also corresponds to amino acids 390-801 of HUMC5_P6 (SEQ ID NO:101), a bridging amino acid V corresponding to amino acid 802 of HUMC5_P6 (SEQ ID NO:101), a third amino acid sequence being at least 90% homologous to GISNTGICVADTVKAKVFKDVFLEM-NIPYSVVRGEQIQLKGTVYNYRTSGMQ corresponding to amino acids 803-854 of CO5_HUMAN (SEQ ID NO:147), which also corresponds to amino acids 803-854 of HUMC5_P6 (SEQ ID NO:101), and a fourth amino acid sequence being at least 70%, optionally at least 80%, preferably at least 85%, more preferably at least 90% and most preferably at least 95% homologous to a polypeptide having the sequence SLALSPRLECNGKISGQLQVRLPGSSD-SPASASQVAGITGTHHHAQPT (SEQ ID NO:103) corresponding to amino acids 855-902 of HUMC5_P6 (SEQ ID NO:101), wherein said first amino acid sequence, bridging amino acid, second amino acid sequence, bridging amino acid, third amino acid sequence and fourth amino acid sequence are contiguous and in a sequential order.

2. An isolated polypeptide for a tail of HUMC5_P6 (SEQ ID NO:101), comprising a polypeptide being at least 70%, optionally at least about 80%, preferably at least about 85%, more preferably at least about 90% and most preferably at least about 95% homologous to the sequence SLAL-SPRLECNGKISGQLQVRLPGSSD-SPASASQVAGITGTHHHAQPT (SEQ ID NO:103) in HUMC5_P6 (SEQ ID NO:101).

The C5 splice variant T11 (transcript: HUMC5_T11—SEQ ID NO:105; polypeptide: HUMC5_P7—SEQ ID NO:104; FIGS. 69c and d, respectively) results from the alternative splicing of the C5 gene, thus introducing a new exon (exon 8A), leading to insertion of a stop codon and the generation of a truncated protein (FIGS. 70, 71b, 72). C5 T11 consists of amino acids 1-292 of the wild type protein (CO5_HUMAN; SEQ ID NO:147) and a unique sequence of 5 amino acids at the C-terminus (RAEVR; SEQ ID NO:106). It only contains the N-terminal portion of the α2-macroglobulin.

Comparison Report Between HUMC5_PROT_OF_TR11 (SEQ ID NO:105) and CO5_HUMAN

1. An isolated chimeric polypeptide HUMC5_PROT_OF_TR11, comprising a first amino acid sequence being at least 90% homologous to MGLLGILCFLIFLGKTWGQEQTYVISAP-KIFRVGASENIVIQVYGYTEAFDATIS IKSYPDKKF-SYSSGHVHLSSENKFQNSAILTIQP-KQLPGGQNPVSYVYLEVVSK HFSKSKRMPITYDNGFLFIHTDKPVYTP-DQSVKVRVYSLNDDLKPAKRETVLT FIDPEGSEVDM-VEEIDHIGIISFPDFKIPSNPRYGMW-TIKAKYKEDFSTTGTAYF EVKEYVLPHFSVSIEPEYNFIGYKNFKN-FEITIKARYFYNKVVTEADVYITFGIR EDLKD-DQKEMMQTAMQNTML corresponding to amino acids 1-292 of CO5_HUMAN, which also corresponds to amino acids 1-292 of HUMC5_PROT_OF_TR11, and a second amino acid sequence being at least 70%, optionally at least 80%, preferably at least 85%, more preferably at least 90% and most preferably at least 95% homologous to a polypeptide having the sequence RAEVR corresponding to amino acids 293-297 of HUMC5_PROT_OF_TR11, wherein said first amino acid sequence and second amino acid sequence are contiguous and in a sequential order.

2. An isolated polypeptide for a tail of HUMC5_PROT_OF_TR11, comprising a polypeptide being at least 70%, optionally at least about 80%, preferably at least about 85%, more preferably at least about 90% and most preferably at least about 95% homologous to the sequence RAEVR in HUMC5_PROT_OF_TR11.

Comparison Report Between HUMC5_P7 (SEQ ID NO:104) and CO5_HUMAN (SEQ ID NO:147)

1. An isolated chimeric polypeptide HUMC5_P7 (SEQ ID NO:104), comprising a first amino acid sequence being at least 90% homologous to MGLLGILCFLIFLGKTWGQEQ-TYVISAPKIFRVGASENIVIQVYGYTEAFDATIS IKSYPDKKFSYSSGHVHLSSENKFQN-SAILTIQPKQLPGGQNPVSYVYLEVVSK HFSKSKRM-PITYDNGFLFIHTDKPVYTPDQS-VKVRVYSLNDDLKPAKRETVLT FIDPEGSEVDMVEEIDHIGHSFPD-FKIPSNPRYGMWTIKAKYKEDFSTTGTAYF EVKEYV-LPHFSVSIEPEYNFIGYKNFKNEEI-TIKARYFYNKVVTEADVYITFGIR EDLKDDQKEMMQTAMQNTML corresponding to amino acids 1-292 of CO5_HUMAN (SEQ ID NO:147), which also corresponds to amino acids 1-292 of HUMC5_P7 (SEQ ID NO:104), and a second amino acid sequence being at least 70%, optionally at least 80%, preferably at least 85%, more preferably at least 90% and most preferably at least 95% homologous to a polypeptide having the sequence RAEVR (SEQ ID NO:106) corresponding to amino acids 293-297 of HUMC5_P7 (SEQ ID NO:104), wherein said first amino acid sequence and second amino acid sequence are contiguous and in a sequential order.

2. An isolated polypeptide for a tail of HUMC5_P7 (SEQ ID NO:104), comprising a polypeptide being at least 70%, optionally at least about 80%, preferably at least about 85%, more preferably at least about 90% and most preferably at least about 95% homologous to the sequence RAEVR (SEQ ID NO:106) in HUMC5_P7 (SEQ ID NO:104).

Therapeutic Applications for the C5 Splice Variant T7 and T11

C5 is activated when a C5-specific convertase cleaves the α-chain in a single site at Arg 733 yielding the C5a fragment and C5b, which is comprised of the remaining larger fragment of the α-chain associated in a S—S bond to the β-chain. However, the major convertase-binding site lies downstream of the cleavage site, within the NTR domain at residues 1600-1620. Other binding sites of C5 to C5 convertase reside on the β-chain near residues 150-200 and another putative binding sites reside at position 863 of the α-chain.

The complement variant T7 consists of 854 amino acids of the N-terminus of the wild type protein. Thus, it lacks some of the C5 convertase binding sites and will probably not bind properly to the convertase and will not be cleaved. Still, the variant contains the convertase binding site on the β-chain (and maybe other, not yet known, binding sites), and thus, might interfere with the binding of the convertase with the wild type C5, and might serve as a weak antagonist.

The T7 variant will also not bind C6 and C7 of the membrane attack complex as this interaction occurs via the NTR domain.

The Complement component C5 variant T11 harbors a binding site for the C5 convertase, which resides at amino acids 150-200. Thus, T11 might interfere with the interaction between C5 convertase and C5 by competing for this binding site, and may thus serve as an antagonist of complement activation, i.e., a therapeutic agent.

It will be appreciated that such an agent can be administered or provided to an individual in need thereof per se or as part of a pharmaceutical composition with a pharmaceutical acceptable carrier (e.g., PEG and liposomes).

The complement component C5 variants according to the present invention optionally and preferably modulate complement component C5-related processes. Preferably, these variants are weak agonists or mixed antagonist/agonists, or antagonists. Therefore, the variants according to the present invention preferably act as antagonists to such complement component C5 mediated processes as adult respiratory distress syndrome, inflammatory reactions, neutrophil accumulation (optionally related to chronic obstructive pulmonary disease (COPD) and in inflammatory responses that result from ischemia in myocardial tissues), multiple sclerosis and Alzheimer's disease, and/or autoimmune disorders such as arthritis, and/or renal disease, cardiovascular reperfusion injury, arthritis, neuroprotective agents and for urological use.

As weak agonists, such variants may optionally be used to treat *Neisseria*, for example.

Treatment may optionally be periodic (weekly or monthly for example, or any other period) or daily depending upon the disease and the need of the subject. Treatment modality could easily be determined by one of ordinary skill in the art.

Example 22

Bone Morphogenetic Protein Receptor Type II

Background

Bone morphogenetic proteins (BMPs) are members of the TGF-beta superfamily of polypeptides. More than 20 mammalian BMPs have been identified so far. BMPs regulate cell proliferation and differentiation, apoptosis, neurogenesis, mesoderm patterning, left-right asymmetry, and the development of a number of organs, such as kidney, gut, lung, teeth, limb, amnion, and testis (Wozney et al, 1988, Science 242, 1528-1534; Hogan, 1996 Curr. Opin. Genet. Dev. 6:432-438; Hogan, 1996, Genes Dev. 10:1580-1594). BMPs were originally identified because of their ability to induce endochondral bone and cartilage formation (Wang E A, et al., 1988, PNAS, 85:1-5; Wozney et al, 1988, Science 242, 1528-1534). BMPs are synthesized by skeletal cells, however, their synthesis is not limited to bone, and they are expressed by a variety of extraskelletal tissues, such as monocytes, epithelial cells, mesenchymal cells and neuronal cells (Balemans and Van Hul, 2002, Dev. Biol. 250:231-250), in which they demonstrate broad array of biological activities and play a critical role in development and cell function. BMPs have also been found to promote nerve cell differentiation and to affect hair follicle formation (K. Basler, T. Edlund, T. M. Jessell, and T. Yamada, Cell, 73: 687-702 (1993); V. M. Paralkar, B. S. Weeks, Y. M. Yu, H. K. Klieinman, and A. H. Reddi, J. Cell Biol., 119: 1721-1728 (1992); M. Blessing, L. B. Nanney, L. E. King, C. M. Jones, and B. L. Hogan, Genes Dev., 7: 204-215 (1993)).

A BMP initiates its biological effect on cells by binding to a specific BMP receptor expressed on the plasma membrane of a BMP-responsive cell. The receptors for various members of the TGF-beta superfamily share similar structural features, and they are typically classified into one of two sub-groups, designated as type I and type II, classified as such based on amino acid sequence characteristics. Both the type I and type II receptors possess a relatively small extracellular ligand binding domain, a transmembrane region, and an intracellular protein kinase domain that is predicted to have serine/threonine kinase activity (Lin and Moustakas, Cellular and Molecular Biology, 40: 337-349 (1994); L. S. Mathews, Endocrine Reviews, 15: 310-325 (1994); L. Attisano, J. L. Wrana, F. Lopez-Casillas, and J. Massague, Biochimica et Biophysica Acta, 1222: 71-80 (1994)). There are three type I receptors identified: Alk2, Alk3 (BRIa) and Alk6 (BRIb), and three type II receptors: BRII, ActRII and ActRIIB, which are capable of binding BMPs (Nohe et al, Cellular Signaling, 2004, 16, 291-299; Yamashita et al., 1994, 269:20172-8; Yamashita et al., 1996, 19:569-574). There is also an alternative splice variant of BRII, which lacks most of the C-terminal tail (Massague, Annu Rev Biochem 1998, 67:753-91; Nohe et al, JBC, 2002, 277:5330-8). Signaling by BMPs requires the presence of both type I and type II receptors on the surface of the same cell. Generally, the type I receptors are the high affinity binding receptors, whereas the Type II receptors bind the BMPs alone with low affinity. The Type II receptors are constitutive active serine threonine kinase receptors. The Type I receptor, which is also a serine threonine kinase, is activated by the Type II receptor by phosphorylation at the GS-Box a juxtamembrane domain enriched in glycines and serines. The ligand can bind to the preformed hetero-oligomeric complexes consisting of at least one Type I and one Type II receptor, leading to the recrution of the pathway restricted Smads (R-Smads, Smads 1, 5, or 8). Alternative option is that the BMP ligand binds to the high affinity receptor Alk3 or Alk6 and then recruit BRII into a hetero-oligomeric complex (BMP-induced signaling complex), leading to activation of the MAP kinase pathway mediated by Tak1/Tab1 leading to the activation of P38 pathway. Kinase deficient BRII receptor mutant that is incapable in forming pre-assembled receptor complexes but recruits into a BMP-induced receptor complex does not interfere with the Smad pathway but does inhibit the induction of alkaline phoshatase as well as P38 phosphorylation (Nohe et al, 2002, JBC, 277: 5330-8).

Mutations in Bone morphogenetic protein receptor type II are the cause of primary pulmonary hypertension (PPH1), a rare progressive autosomal dominant disorder, in which widespread occlusion of the smallest pulmonary arteries leads to increased pulmonary vascular resistance, and subsequently right ventricular failure. The mechanism by which BMPR-II mutants disrupt BMP/Smad signalling is heterogeneous and mutation specific. Thus, substitution of cysteine residues within the ligand binding or kinase domain of BMPR-II leads to failure of trafficking of the mutant protein to the cell surface, which may interfere with wild-type receptor trafficking. In contrast, noncysteine mutations within the kinase domain reach the cell surface but fail to activate a Smad-responsive luciferase reporter gene. All mutants transfected into normal mouse epithelial cells demonstrated ligand-independent activation of p38MAPK and enhanced serum-induced proliferation. Thus the reduced cell surface expression of BMPR-II favors activation of p38MAPK-dependent proproliferative pathways, whilst inhibiting Smad-dependent signalling in a mutation specific manner (Eddahibi et al, 2002, Eur Respir J, 20:1559-1572; Rudarakanchana et al, 2002, Human Mol Genet, 11:1517-1525). These alterations in BMPR-II function may provide the trigger for the abnormal vascular remodeling that characterizes primary pulmonary hypertension.

BMPs and agonists of BMP signaling pathway can be used as therapeutic agents for various indications. Among them are stimulation of maturation of chondrocytes and osteoblasts, thereby enhancing the bone-like tissue formation, which can be crucial for orthopedic repair of bone fractures, treatment of degenerative rheumatic and traumatic bone disorders, facial reconstructive surgery, stomatological diseases and dental surgery, bone loss due to osteoporosis, treatment of cartilage defects in joints and for use in bone transplants. Further potential indications for BMP pathway modulators include tissue regeneration in neurology, angiogenesis, burn and wound repair, Parkinson's disease, diabetic and gastrointestinal ulcers.

A recombinant BMP7 growth factor (developed by Curis; Stryker Biotech; Johnson & Johnson), eptoterminalpha, was currently launched for use as a muskuloskeletal osteogenic drug, and it is now under advanced investigation for potential uses for osteoporosis treatment, as well as in urological and stomatological diseases, as a neuroprotective agent and as an antiparkinsonian agent.

Morphogens, such as BMP7, BMP8, BMP2, BMP4, BMP6, are potentially useful for treatment of ischemic or traumatic injury of the central nervous system, in particular, in cases when the central nervous system tissue has been damaged or lost due to stroke or a similar disruption in blood flow, or due to infliction of physical (e.g., mechanical) trauma affecting the central nervous system (U.S. Pat. No. 6,407,060).

BMPs are also potentially useful as therapeutic molecules for protecting the luminal lining of the gastrointestinal tract from ulceration, particularly in individuals at risk for ulcer formation. Specifically they can limit the proliferation of the epithelial cells, inhibit the inflammation normally associated with ulcerative disease, inhibit scar tissue formation, and induce repair and regeneration of the ulcerated tissue (U.S. Pat. Nos. 6,399,569; 5,739,107).

Recently, the involvement of growth factors, such as GDF-9B and BMP6 in oocyte development and follicle growth was demonstrated (Vitt et al, 2002, Biol Reprod, 67:473-80; Gilchrist et al, 2004, Anim Reprod Sci., 82-83:431-46; Shimasaki et al., 2003, Reprod Suppl, 61: 323-37). Bone morphogenetic protein receptor Type II is a receptor for GDF-9, which is secreted by oocyte and is capable of stimulating granulose cell proliferation and inhibiting differentiation (Vitt et al, 2002, Biol Reprod, 67:473-80). Thus the BMP signaling pathway modulators can be for reproductive disorders.

The role of BMPs and it receptors in pathogenesis of allergic asthma and other airway diseases was recently demonstrated (Gronenberg et al, 2004, Exp. Lung Res., 30:223-50; Rosendahl et al., 2002, Am. J. Respir. Cell Mol. Biol. 27:160-169), suggesting the BMP signaling pathway as an important target for future development of new therapeutic strategies for asthma, chronic obstructive pulmonary diseases and airway inflammation. A failure to reconstitute normal lung architecture, and a number of structural changes (including extensive epithelial damage, deposition of ECM, goblet cell metaplasia, smooth muscle hypertrophy, increase in nerves and blood vessels) contribute to the tissue remodeling that is associated with asthma. A mechanistic explanation for the failure of EGF signaling to mediate proper repair has been suggested to be abnormally high signaling from the antagonistic pathways stimulated by members of the TGF-beta family and BMP-stimulated signaling in allergen-challenged airway epithelium. Thus, modulation and preferably downregulation of the BMP signaling pathway may be considered as therapeutic target for asthma, chronic obstructive pulmonary diseases and airway inflammation. BMPs and BMP signaling pathways have also potential utilities as diagnostic, prognostic and therapeutic targets in various cancers, such as osteosarcomas. Osteosarcomas producing BMPs contain less-differentiated mesenchymal cells, resulting in a poorer prognosis for those patients. Among benign bone tumors, BMPs are expressed in osteoid osteomas or osteoblastomas and effect reactive bone formation such as a surrounding sclerosis.

Antagonists of BMP signaling pathway can be potentially used in the treatment of inappropriate bone formation resulting from complications associated with spinal trauma or major burns, for the treatment of post-surgical adhesions and fibrosis, and for treatment of fibrodysplasia ossificans progressive and other disorders of heterotopic ossification (Kan et al; Am J Pathol. 2004 October; 165(4):1107-15; Glasercet al, J Bone Joint Surg Am. 2003 December; 85-A(12):2332-42).

Heterotopic ossification, the formation of bone in soft tissue, requires inductive signaling pathways, inducible osteoprogenitor cells, and a heterotopic environment conducive to osteogenesis. In fibrodysplasia ossificans progressiva, overexpression of BMP4 and underexpression of multiple antagonists of this protein highlight the potential role of a BMP signaling pathway in these disorders and turns it in to a promising therapeutic target (Kaplan et al, J Am Acad Orthop Surg. 2004 March-April; 12(2): 116-25). The delivery of BMP inhibitor Noggin mediated by muscle-derived stem cells successfully inhibited heterotopic ossification caused by BMP-4, demineralized bone matrix, and trauma in an animal model (Hannallah et al, J Bone Joint Surg Am. 2004 January; 86-A(1):80-91). The heterotopic ossification of muscles, tendons, and ligaments is a common problem faced by orthopaedic surgeons. Blocking bone formation is clinically relevant to disorders of heterotopic ossification in humans, such as fibrodysplasia ossificans progressiva. Furthermore, development of BMP antagonists as therapeutic agents may provide modalities for the treatment of other pathologic conditions that arise from aberrant expression of BMPs and/or from a lack of their antagonists.

BMP antagonists, blocking growth factor signaling, were shown to cause a significant reduction of osteophyte formation and synovial thickening during experimental osteoarthritis (Scharstuhl et al., Arthritis Rheum. 2003 December; 48(12):3442-51), which is a joint disease characterized by osteophyte development, fibrosis, and articular cartilage damage. These findings suggest potential therapeutic uses of antagonists of BMP signaling pathway in the osteoarthritis treatment.

Antagonists of BMP signaling pathway can be also potentially used to improve central nervous system (CNS) regeneration after spinal cord injury. Transplantation of neural precursor cells into lesioned adult rat spinal cord results in only partial functional recovery, and most transplanted cells tend to differentiate predominantly into astrocytes. In order to improve functional recovery after transplantation, it is important that transplanted neural precursor cells appropriately differentiate into cell lineages required for spinal cord regeneration. It was demonstrated that gene modification to inhibit BMP signaling by noggin expression promoted differentiation of neural precursor cells into neurons and oligodendrocytes, in addition to astrocytes after transplantation. Furthermore, functional recovery of the recipient mice with spinal cord injury was observed when noggin-expressing neural precursor cells were transplanted (Setoguchi et al., Exp Neurol. 2004 September; 189(1):33-44.).

Bone Morphogenetic Protein Receptor type II (BMR11) Novel Splice Variant

Figure 91:
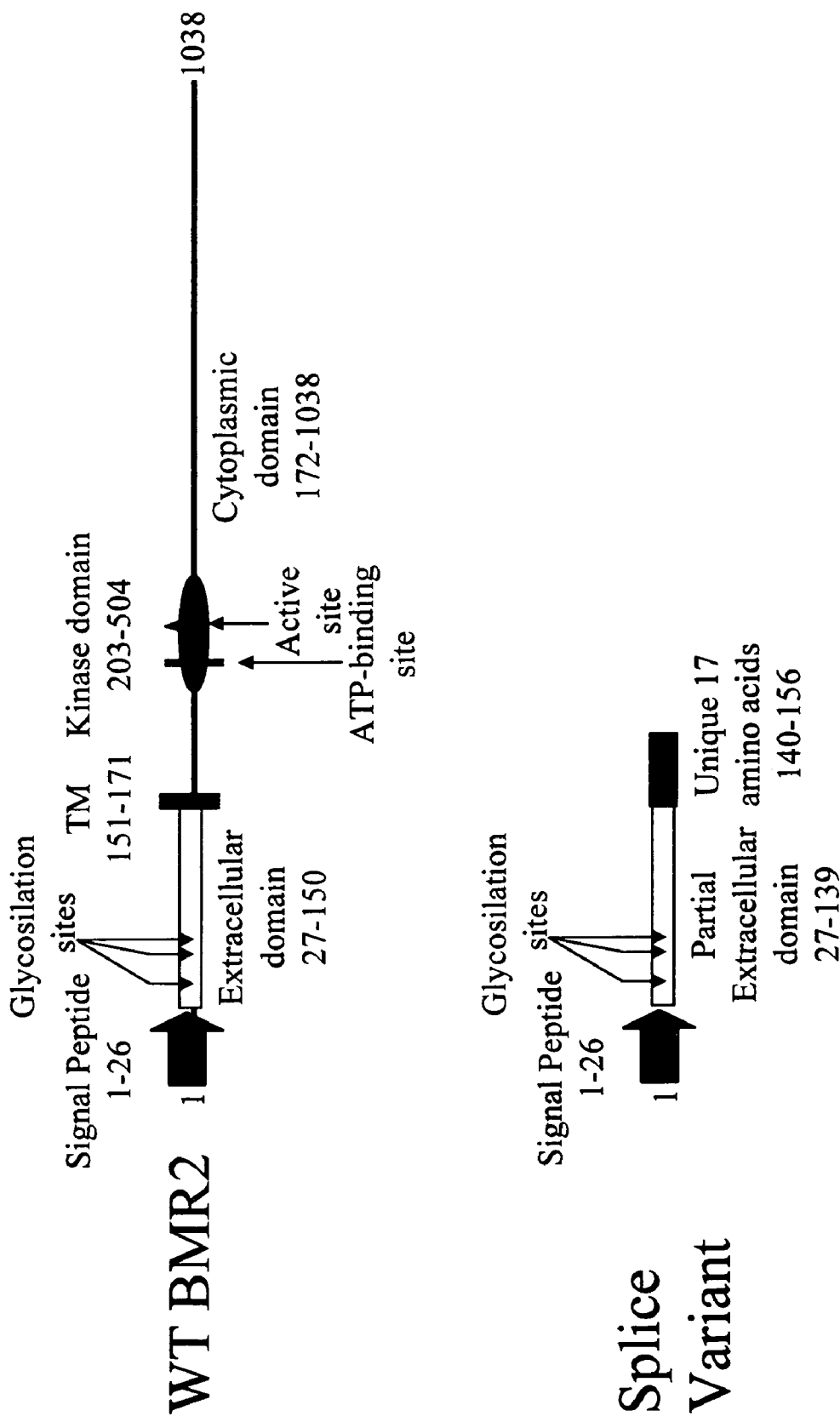
FIG. 91 is a schematic illustration showing the protein domain structure of wild-type Bone morphogenetic protein receptor type II (SwissProt locus: BMR2_HUMAN; SEQ ID NO:152) and the variant of the present invention (SEQ ID NO:120).

BMRII splice variant of the present invention (HSU20165_T9; SEQ ID NO:121) results from an alternative splicing of the BMRII_HUMAN gene, incorporating an alternative new exon sequence located within the intronic sequence between the original exons 3 and 4 of the BMRII gene. As a result a new truncated BMRII protein is generated, encoding 156 amino acids (HSU20165_P5; SEQ ID NO:120), which shares with the wild type BMRII the 139 N-terminal amino acids, containing the signal peptide sequence (amino acids 1-26), partial extracellular ligand binding domain (amino acids 27-139), including the three potential glycosylation sites. The new protein contains 17 C-terminal unique amino acids. The new protein does not contain the transmembrane domain of the wild type protein, and therefore it is predicted to be secreted. The new protein does not contain the cytoplasmic domain of the wild type protein, including the kinase domain. The sequence alignment between the novel BMRII splice variant of the present invention and the known BMRII is presented in FIG. 90. The schematic drawing of the new variant as compared to the wild type protein is presented in FIG. 91.

Comparison Report Between HSU20165_P5 (SEQ ID NO:120) and BMR2_HUMAN (SEQ ID NO:152)

1. An isolated chimeric polypeptide HSU20165_P5 (SEQ ID NO:120), comprising a first amino acid sequence being at least 90% homologous to MTSSLQRPWRVPWLPWTILLVSTAAASQNQERLCAFKD-PYQQDLGIGESRISH ENGTILCSKGSTCYGLWEK-SKGDINLVKQGCWSHIGDPQECHYEECVVTTTP PSIQNGTYRFCCCSTDLCNVNFTENFPPPDTTPL corresponding to amino acids 1-139 of BMR2_HUMAN (SEQ ID NO:152), which also corresponds to amino acids 1-139 of HSU20165_P5 (SEQ ID NO:120), and a second amino acid sequence being at least 70%, optionally at least 80%, preferably at least 85%, more preferably at least 90% and most preferably at least 95% homologous to a polypeptide having the sequence KTGFHRVSQDGLDLLTS (SEQ ID NO:334) corresponding to amino acids 140-156 of HSU20165_P5 (SEQ ID NO:120), wherein said first amino acid sequence and second amino acid sequence are contiguous and in a sequential order.

2. An isolated polypeptide for a tail of HSU20165_P5 (SEQ ID NO:120), comprising a polypeptide being at least 70%, optionally at least about 80%, preferably at least about 85%, more preferably at least about 90% and most preferably at least about 95% homologous to the sequence KTGFHRVSQDGLDLLTS (SEQ ID NO:334) in HSU20165_P5 (SEQ ID NO:120).

The new secreted splice variant of BMRII (HSU20165_P5 (SEQ ID NO:120) is predicted to have a dominant negative mode of action with antagonistic effects on the BMP signaling pathway. The BMRII splice variant of the present invention has various potential therapeutic and diagnostic implications. Thus a BMRII polypeptide homologous to SEQ ID NO:120, and/or a BMRII polynucleotide homologous to SEQ ID NO:121 and/or a peptide homologous to SEQ ID NO:334 can be used as a negative modulator of the BMP signaling pathway, and hence serve as a potential therapeutic agent in pathological conditions where blocking or reducing the BMP signaling is required, such as in the treatment of inappropriate bone formation resulting from spinal trauma or major burns; the treatment of post-surgical adhesions and fibrosis; treatment of fibrodysplasia ossificans progressive and other disorders of heterotopic ossification, including the heterotopic ossification of muscles, tendons, and ligaments, which is a common problem faced by orthopaedic surgeons; treatment of osteoarthritis; it can be potentially used to improve central nervous system (CNS) regeneration after spinal cord injury; for treatment of asthma, chronic obstructive pulmonary diseases and airway inflammation; and it can be potentially used as diagnostic, prognostic and therapeutic target in various cancers, such as osteosarcomas.

It will be appreciated that such an agent can be administered or provided to an individual in need thereof per se or as part of a pharmaceutical composition with a pharmaceutical acceptable carrier (e.g., PEG and liposomes).

Example 23

Splice Variant of Vascular Endothelial Growth Factor A Precursor

Background

The Vascular endothelial growth factor A precursor (VEGF-A; VPF; VEGA_HUMAN; SEQ ID NO:196) is a growth factor which is active in angiogenesis, vasculogenesis, endothelial cell growth, heparin binding angiogenesis, regulation of cell cycle and immune response. It acts as an angiogenesis modulator, induces endothelial cell proliferation, promotes cell migration, inhibits apoptosis, and induces permeabilization of blood vessels. VEGF-A binds to the VEGFR1/Flt-1 and VEGFR2/Kdr receptors, heparan sulfate and heparin. Alternative splicing of the VEGF-A precursor results in several VEGF isoforms: VEGF-121, VEGF-148, VEGF-165, VEGF-183, and VEGF-189. Neuropilin-1 binds isoforms VEGF-165 and VEGF-145.

VEGF-A is implicated in various diseases including, atherosclerosis, peripheral vascular disease, ulcer, diabetic, angina, general, rheumatoid arthritis, Buerger's syndrome, ischaemic cardiomyopathy, endometriosis, heart failure, myocardial infarction, ischaemia, macular degeneration, macular oedema, psoriasis, restenosis, diabetic retinopathy, wound healing, as well as in various cancers such as basal cell carcinoma, lung cancer (small cell and non-small cells lung cancer), brain cancer, breast cancer, cervical cancer, colorectal cancer, head and neck cancer, leukaemia, acute myelogenous, lymphoma, non-Hodgkin's lymphoma, melanoma; mesothelioma, myeloma, ovarian cancer, pancreatic cancer, prostate cancer, renal cancer, sarcoma, Kaposi's sarcoma.

Since VEGF-A is overexpressed in various cancers such as AIDS-associated Kaposi's sarcoma (KS) it can be used as a diagnostic marker for cancer. In addition, KS lesional cells express and respond to VEGF and bFGF, thus exhibit an inherent angiogenic phenotype which is crucial for cancer progression. Prior studies have attempted to treat KS lesions by introducing endostatin, a 20 kDA carboxyl-terminal fragment of collagen XVIII, which exhibits potent angiostatic activity (Mallery S R, J Cell Biochem. 2003; 89: 133-43).

Splice Variant HUMEGFAA_T5 (SEQ ID NO:194) Encodes a New Truncated Form of the VEGF-A, HUMEGFAA_P6 (SEQ ID NO:195)

The present inventors have uncovered a new VEGF-A variant [HUMEGFAA_P6—SEQ ID NO:195; HUMEGFAA_T5—SEQ ID NO:194]. The protein coordinates on the transcript start from nucleotide 1040 and end at nucleotide 1582 as set forth in SEQ ID NO:194 (HUMEGFAA_T5 transcript).

Alignment of the new VEGF-A variant (HUMEGFAA_P6—SEQ ID NO:195) with the WT protein (GenBank Accession No. P15692; SEQ ID NO:196) revealed that the new variant includes the first 130 amino acids as of the WT protein (GenBank Accession No. P15692), is missing 52 amino acids [RPKKDRARQEKKSVRGKGKGQKRKRKKSRYKSWSVYVGARCCLMPWSLPGPH (SEQ ID NO:197), FIG. 110] at position 131-182 of the WT protein, and further includes amino acids 183-232 of the WT protein. Thus, the new variant uncovered by the present invention lacks the bipartite nuclear localization signal (IPR001472) of the WT protein and therefore is expected to be an antagonist of VEGF-A.

Comparison Report Between HUMEGFAA_P6 (SEQ ID NO:195) and VEGA_HUMAN (SEQ ID NO:196)

1. An isolated chimeric polypeptide HUMEGFAA_P6 (SEQ ID NO:195), comprising a first amino acid sequence being at least 90% homologous to MNFLLSWVHWSLA-LLLYLHHAKWSQAAPMAEGGGQNHHEV-VKFMDVYQR SYCHPIETLVDIFQEYPDEIEYIFKP-SCVPLMRCGGCCNDEGLECVPTEESNITM QIMRIKPHQGQHIGEMSFLQHNKCEC corresponding to amino acids 1-130 of VEGA_HUMAN (SEQ ID NO:196), which also corresponds to amino acids 1-130 of HUMEGFAA_P6 (SEQ ID NO:195), a second amino acid sequence bridging amino acid sequence comprising of S, and a third amino acid sequence being at least 90% homologous to PCG-PCSERRKHLFVQDPQTCKCSCKNTD-SRCKARQLELNERTCRCDKPRR corresponding to amino acids 183-232 of VEGA_HUMAN (SEQ ID NO:196), which also corresponds to amino acids 132-181 of HUMEGFAA_P6 (SEQ ID NO:195), wherein said first amino acid sequence, second amino acid sequence and third amino acid sequence are contiguous and in a sequential order.

2. An isolated polypeptide for an edge portion of HUMEGFAA_P6 (SEQ ID NO:195), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise CSP having a structure as follows (numbering according to HUMEGFAA_P6 (SEQ ID NO:195)): a sequence starting from any of amino acid numbers 130-x to 130; and ending at any of amino acid numbers 132+((n−2)−x), in which x varies from 0 to n−2.

Splice Variant HUMEGFAA_T12 (SEQ ID NO:198) Encodes a New Form of the VEGF-A, HUMEGFAA_P8 (SEQ ID NO:199)

The present inventors have uncovered a new VEGF-A variant [HUMEGFAA_T12—SEQ ID NO:198; HUMEGFAA_P8—SEQ ID NO:1991. The protein coordinates on the transcript start from nucleotide 1040 and end at nucleotide 1450 as set forth in SEQ ID NO:198 (HUMEGFAA_T12 transcript).

Alignment of the new VEGF-A variant (HUMEGFAA_P8—SEQ ID NO:199) with the WT protein (GenBank Accession No. P15692; SEQ ID NO:196) revealed that the new variant includes the first 104 amino acids as of the WT protein (GenBank Accession No. P15692), is missing 95 amino acids of the WT (105-199 of SEQ ID NO:196; QIMRIKPHQGQHIGEMSFLQHNKCECRP-KKDRARQEKKSVRGKGKGQKRKR KKSRYKSWS-VYVGARCCLMPWSLPGPHPCGPCSERRKHLFVQDP (SEQ ID NO:200), FIG. 110], and it further includes amino acids 200-232 of the WT. The new variant uncovered by the present invention lacks the Bipartite nuclear localization signal (IPR001472) and the Platelet-derived growth factor (IPR000072) of the WT protein and therefore is expected to be antagonist of the endogenous VEGF-A protein.

Comparison Report Between HUMEGFAA_P8 (SEQ ID NO:199) and VEGA_HUMAN (SEQ ID NO:196)

1. An isolated chimeric polypeptide HUMEGFAA_P8 (SEQ ID NO:199), comprising a first amino acid sequence being at least 90% homologous to MNFLLSWVHWSLA-LLLYLHHAKWSQAAPMAEGGGQNHHEV-VKFMDVYQR SYCHPIETLVDIFQEYPDEIEYIFKP-SCVPLMRCGGCCNDEGLECVPTEESNITM corresponding to amino acids 1-104 of VEGA_HUMAN (SEQ ID NO:196), which also corresponds to amino acids 1-104 of HUMEGFAA_P8 (SEQ ID NO:199), and a second amino acid sequence being at least 90% homologous to QTCKCSCKNTDSRCKARQLELNERTCRCDKPRR corresponding to amino acids 200-232 of VEGA_HUMAN (SEQ ID NO:196), which also corresponds to amino acids 105-137 of HUMEGFAA_P8 (SEQ ID NO:199), wherein said first amino acid sequence and second amino acid sequence are contiguous and in a sequential order.

2. An isolated chimeric polypeptide for an edge portion of HUMEGFAA_P8 (SEQ ID NO:199), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise MQ, having a structure as follows: a sequence starting from any of amino acid numbers 104-x to 104; and ending at any of amino acid numbers 105+((n−2)−x), in which x varies from 0 to n−2.

Clinical Implications of the VEGF-A Variants of the Present Invention

Since the VEGF-A variants of the present invention lack the nuclear localization signal it can compete with the endogenous VEGF-A and interfere with its various activities.

Thus, the present inventors have uncovered a therapeutic agent, a polypeptide homologous to SEQ ID NO:195 or 199 and/or an expressible polynucleotide homologous to SEQ ID NO:194 or 198 which can be used to treat cancer [e.g., basal cell carcinoma, lung cancer (small cell and non-small cells lung cancer), brain cancer, breast cancer, cervical cancer, colorectal cancer, head and neck cancer, leukaemia, acute myelogenous, lymphoma, non-Hodgkin's lymphoma, melanoma; mesothelioma, myeloma, ovarian cancer, pancreatic cancer, prostate cancer, renal cancer, sarcoma, Kaposi's sarcoma], a cardiovascular disease, inflammation, hypolipemia, fungal disease, angina, allergy, asthma, arthritis, psoriasis, atherosclerosis, symptomatic diabetes, menstruation disorder, musculoskeletal, ophthalmological, protozoacide, urological disease. In addition such an agent can be used as a fertility or reproduction enhancer, recombinant growth factor, coronary vasodilator, vulnerary, cardiostimulant, immunostimulant, immunosuppressant, a peripheral vasodilator.

It will be appreciated that such an agent can be administered or provided to an individual in need thereof per se or as part of a pharmaceutical composition with a pharmaceutical acceptable carrier (e.g., PEG and liposomes).

These results suggest the use of the new VEGF-A variant of the present invention (SEQ ID NO:195) and/or the polynucleotide encoding same (SEQ ID NO:194) as a diagnostic marker for cell proliferation or de-differentiation, as well as various cancers and tumors as is mentioned hereinabove. Diagnosis according to this aspect of the present invention is effected using immunological assays [e.g., Western Blot, immunohistochemistry, FACS analysis, radio immuno assay (RIA), immunofluorescence, and the like using an antibody directed against the VEGF-A variant [HUMEGFAA_P6—SEQ ID NO:195], or by nucleic acid techniques (NAT) such as RT-PCR, Northern Blot, in situ hybridization, in situ RT-PCR.

Example 24

Splice Variant of Interleukin-1 Receptor, Type I Precursor

Background

Interleukin-1 receptor (IL1R; IL1R$_1$; IL1RA; IL-1R-1; IL-1R-alpha; P80; Antigen CD121a; P14778; IL1R_HUMAN) is a type I membrane protein which can bind interleukin-1 alpha (IL-1α), IL-1β, and interleukin-1 receptor antagonist protein (IL-1RA). Binding of IL-1α or IL-1β involves the formation of a ternary complex containing IL1RAP, TOLLIP, MYD88, IRAK1 or IRAK2 and leads to activation of NF-kappa-B.

IL-1Rα involves in immune and inflammatory responses and has been implicated in various diseases, disorders or conditions such as allergy, amyotrophic lateral sclerosis, rheumatoid arthritis, asthma, infection, inflammation (e.g., inflammatory bowel disease, sepsis, ocular inflammation), bone marrow transplant rejection, Alzheimer's disease, aplastic anaemia, osteo arthritis, cancer (e.g., breast, colorectal, melanoma, myeloma, prostate cancer, sarcoma), chemotherapy-induced injury, colitis, ulcerative, diabetes, fever, glaucoma, head trauma, ischaemia, cerebral myelodysplastic syndrome, nephritis, neuropathy, diabetic ocular disorder, pain, Parkinson's disease, Surgery adjunct, Ulcer decubitus.

IL-1Rα is overexpressed in various cancers and can be used as a marker for diagnosing cancer.

Splice Variant HUMIL1RA_T8 (SEQ ID NO:201) Encodes a New Secreted Form of the IL-1Rα, HUMIL1RA_P3 (SEQ ID NO:202)

The present inventors have uncovered a new IL-1Rα variant [HUMIL1RA_T8—SEQ ID NO:201; HUMIL1RA_P3—SEQ ID NO:202]. The protein coordinates on the transcript start from nucleotide 353 and end at nucleotide 850 as set forth in SEQ ID NO:201 (HUMIL1RA_T8 transcript).

Splice Variant HUMIL1RA_T10 (SEQ ID NO:205) Encodes a New Secreted Form of the IL-1Rα, HUMIL1RA_P3 (SEQ ID NO:202)

The present inventors have uncovered another new IL-1Rα variant [HUMIL1RA_T10—SEQ ID NO:205] which encodes the HUMIL1RA_P3 polypeptide (SEQ ID NO:202) described hereinabove. The protein coordinates on the transcript start from nucleotide 252 and end at nucleotide 749 as set forth in SEQ ID NO:205 (HUMIL1RA_T10 transcript).

Alignment of the new IL-1Rα variant (HUMIL1RA_P3—SEQ ID NO:202) with the WT protein (GenBank Accession No. P14778; SEQ ID NO:203) revealed that the new variant includes the first 162 amino acids as of the WT protein (GenBank Accession No. P14778) followed by a unique 4 amino acid sequence [VILF (SEQ ID NO:204), FIG. 112]. The new variant uncovered by the present invention exhibits a truncated Ig-like C2 type 1 domain (amino acids 118-210 of WT) and lacks the Ig-like C2 type 3 (amino acids 226-328 of WT), two glycosylation sites (amino acids 249 and 297 of WT), the transmembrane domain (amino acids 337-356 of WT), the cytoplasmic domain (amino acids 357-569 of WT), and the TIR domain (amino acids 383-541 of WT) and is therefore expected to be a secreted, soluble protein and extracellular protein.

Comparison Report Between HUMIL1RA_P3 and IL1R_HUMAN

1. An isolated chimeric polypeptide HUMIL1RA_P3 (SEQ ID NO:202), comprising a first amino acid sequence being at least 90% homologous to MKVLLRLICFIALLISS-LEADKCKEREEKIILVSSANEIDVRPC-PLNPNEHKGTIT WYKDDSKTPVSTEQASRIHQHKEK-LWFVPAKVEDSGHYYCVVRNSSYCLRI KISAKFVENEPNLCYN-AQAIFKQKLPVAGDGGLVCPYMEFFKNENNELPKLQ WYK corresponding to amino acids 1-162 of IL1R_HUMAN (SEQ ID NO:203), which also corresponds to amino acids 1-162 of HUMIL1RA_P3 (SEQ ID NO:202), and a second amino acid sequence being at least 70%, optionally at least 80%, preferably at least 85%, more preferably at least 90% and most preferably at least 95% homologous to a polypeptide having the sequence VILF (SEQ ID NO:204) corresponding to amino acids 163-166 of HUMIL1RA_P3 (SEQ ID NO:202), wherein said first amino acid sequence and second amino acid sequence are contiguous and in a sequential order.

2. An isolated polypeptide for a tail of HUMIL1RA_P3 (SEQ ID NO:202), comprising a polypeptide being at least 70%, optionally at least about 80%, preferably at least about 85%, more preferably at least about 90% and most preferably at least about 95% homologous to the sequence VILF in HUMIL1RA_P3 (SEQ ID NO:202).

Since the IL-1Rα variant of the present invention lacks the TM and TIR domains it can compete with the endogenous IL-1Rα and interfere with its various activities (i.e., Interleukin 1 modulator).

Thus, the present inventors have uncovered a therapeutic agent, a polypeptide homologous to SEQ ID NO:202, an expressible polynucleotide homologous to SEQ ID NO:201 and/or a peptide homologous to SEQ ID NO:204 which can be used as an anti-inflammatory (e.g., for GI inflammatory, bowel disorders), antiallergic, antiarthritic, antiasthma, anticancer, immunosuppressant, septic shock treatment, analgesic, NSAID, antianaemic, antibiotic, antidiabetic, antiglaucoma, antiparkinsonian, antipsoriasis, antiulcer, antiviral, anti-HIV (anti AIDS), cardiovascular, cognition enhancer, dermatological, haematological, hepatoprotective, hypolipaemic, antiatherosclerosis, immunomodulator, anti-infective, immunostimulant, multiple sclerosis treatment, neurological, neuroprotective, ophthalmological, osteoporosis treatment, radio/chemoprotective, radio/chemosensitizer, respiratory, stomatological, symptomatic antidiabetic, urological, and vulnerary agent.

It will be appreciated that such an agent can be administered or provided to an individual in need thereof per se or as part of a pharmaceutical composition with a pharmaceutical acceptable carrier (e.g., PEG and liposomes).

While further reducing the present invention to practice, these results suggest the use of the new IL-1Rα variant of the present invention (HUMIL1RA_P3—SEQ ID NO:202), the polynucleotide encoding same (HUMIL1RA_T8—SEQ ID NO:201) and/or the peptide derived from the HUMIL1RA_P3 variant (VILF—SEQ ID NO:204) as a diagnostic marker for various cancer cells and tumors (e.g., breast colorectal, melanoma, myeloma, prostate cancer, sarcoma). Diagnosis according to this aspect of the present invention is effected using immunological assays [e.g., Western Blot, immunohistochemistry, FACS analysis, radio immuno assay (RIA), immunofluorescence, and the like using an antibody directed against the IL-1Rα variant (HUMIL1RA_P3—SEQ ID NO:202], or by nucleic acid techniques (NAT) such as RT-PCR, Northern Blot, in situ hybridization, in situ RT-PCR.

Example 25

Splice Variant of Complement Receptor Type I Precursor

Background

Complement receptor type I (CR1, or CD35, or C3b/C4b receptor) belongs to the family of regulators of complement activation (RCA) that includes also complement receptor type II (CRII; CD21), membrane cofactor protein (MCP; CD46), decay accelerating factor (DAF; CD55), factor H, and C4b binding protein. RCA proteins accelerate the dissociation of C3 and C5 convertases, an activity known as decay accelerating activity (DAA), and/or serve as cofactors for the factor I-mediated cleavage of C3b and C4b, that result in inactivation of these molecules, and which is known as cofactor activity (CA).

CR1 is expressed by most peripheral blood cells, including erythrocytes, neutrophils, B-lymphocytes, a subset of T lymphocytes, and monocytes but not on platelets, natural killers cells and most T cells. Additionally, CR1 is expressed by glomerular podocytes and dendritic reticular cells. Erythrocytic CR1 has primary function in the clearance of C3b-fixed immune complexes. Lymphocytic and phagocytic CR1 bearing cells aid in the conversion and inactivation of C3b in the presence of factor-I.

Like all members of RCA family, CR1 is composed of ~60 amino-acid-long repeating units called complement control protein repeats (CCPs, also designated sushi domains). Of the 30 CCPs in CR1, the first 28 are organized, based on internal homology, into four long homologous repeats (LHRs), A-D, each composed of seven CCPs. Analysis of CR1 derivatives carrying a single LHR revealed that LHR A (CCPs 1-7), B (CCPs 8-14) and C(CCPs 15-21) contain binding sites for C3b and C4b. LHR A, efficiently binds C4b but binds C3b weakly. It possesses DAA but has a barely detectable CA. LHR B and its structural-functional duplicate, LHR C, efficiently bind C3b and C4b and possess CA for their cleavage. Within LHR A, binding sites for C4b were mapped to site 1 (CCPs 1-4). Specifically, structure function studies revealed one amino acid on CCP1 and three amino acids on CCP2 possessing binding activity for C4b. Binding sites for C3b were found on CCP8 and 9, which are included within site 2 (CCPs 8-11) of LHR B.

Structural analysis of the CCP units revealed that conserved two disulfide bridges as well as conserved amino acids within the CCPs form a hydrophobic core, which is similar in all CCPs.

Known polymorphisms for the sequence of this WT or known protein are as shown in Table 21.

TABLE 21

Amino acid mutations for Known Protein

| SNP position(s) on amino acid sequence | Comment |
|---|---|
| 1208 | H → R./FTId = VAR_013819. |
| 1408 | T → I./FTId = VAR_013820. |
| 1590 | K → E (in MCC(b) antigen)./FTId = VAR_013821. |
| 1601 | R → G (in Sl(2)/Vil antigen and Sl(5) antigen)./FTId = VAR_013822. |
| 1610 | S → T (in Sl(5) antigen)./FTId = VAR_013823. |
| 1615 | I → V./FTId = VAR_013824. |
| 1827 | P → R./FTId = VAR_013825. |
| 1850 | H → D./FTId = VAR_013826. |
| 1876 | T → I |

Clinical Applications

Erythrocytic CR1 is responsible for the transport of immune complexes (IC) to liver and spleen. CR1 is also a potent inhibitor of complement activation and inflammation as it serves as a cofactor of the C3b cleavage by factor I. In some diseases such as systemic lupus erythematosus, hemolytic anemia, AIDS, and chronic myeloid leukemia, low levels of CR1 on erythrocytes has been observed, leading to an impaired clearance of IC. CR1 agonists are desirable therapeutic agents in such CR1 deficiencies.

Uncontrolled complement activation has been implicated as a pathological process in a number of inflammatory and autoimmune disorders such as rheumatoid arthritis and multiple sclerosis. Antagonistic soluble CR1 (sCR1) have been shown to be effective in experimental models of systemic sclerosis, arthritis, myasthenia gravis, and glomerulonephritis. It has also been shown to suppress ischemia/reperfusion injury, thermal trauma, and immune complex mediated inflammation. Administration of sCR1 in rat model of hyperacute allograft rejection resulted in reduced hemolysis after transplantation an in prolonged graft survival. Thus, Complement inactivation, mediated by sCR1, may prove useful for transplantation. Complement depletion has been shown to affect demyelination and inflammation in models of experimental allergic neuritis. Concomitantly, allergic neuritis was partially inhibited by treatment with sCR1. Thus, sCR1 could also serve as a neuroprotective agent in neuronal inflammation. Many animal models of rheumatoid arthritis are complement dependent and both incidence and progression of disease can be influenced by complement inhibition. Inhibition of complement via CR1 is of a potential therapeutic usage in rheumatoid arthritis.

Additional references which are fully incorporated herein: Krych et al., 1991 PNAS 88: 4353-4357; Krych et al., 1994 JBC 269: 13273-13278; Krych et al., 1998 JBC 273:8623-8629; Krych-Goldberg et al., 1999 JBC 274:31160-31168; Krych-Goldberg et al., 2001 Immunological Reviews 180: 112-122; Asghar et al., 2000 Front Biosci 5:E63-81; Vriesendorp et al., Int J Neurosci 92:287-298; Pruitt et al., J Surg Res 50:350-355).

Splice Variant Structure

The cluster (gene) with regard to these variants, termed HSCR1RS, features 5 transcript(s) and 47 segment(s) of interest, the names for which are given in Tables 22 and 23, respectively, the sequences themselves are given in SEQ ID NOs: 206-210; 211-257 and 261-264, for transcripts; segments and proteins, respectively. The selected protein variants are given in Table 24.

TABLE 22

Transcripts of interest

| Transcript Name | SEQ ID NO |
|---|---|
| HSCR1RS_PEA_1_T5 | 206 |
| HSCR1RS_PEA_1_T9 | 207 |
| HSCR1RS_PEA_1_T10 | 208 |
| HSCR1RS_PEA_1_T13 | 209 |
| HSCR1RS_PEA_1_T14 | 210 |

TABLE 23

Segments of interest

| Segment Name | SEQ ID NO: |
|---|---|
| HSCR1RS_PEA_1_node_1 | 211 |
| HSCR1RS_PEA_1_node_3 | 212 |
| HSCR1RS_PEA_1_node_10 | 213 |
| HSCR1RS_PEA_1_node_12 | 214 |
| HSCR1RS_PEA_1_node_19 | 215 |
| HSCR1RS_PEA_1_node_21 | 216 |
| HSCR1RS_PEA_1_node_27 | 217 |
| HSCR1RS_PEA_1_node_29 | 218 |
| HSCR1RS_PEA_1_node_35 | 219 |
| HSCR1RS_PEA_1_node_37 | 220 |
| HSCR1RS_PEA_1_node_45 | 221 |
| HSCR1RS_PEA_1_node_52 | 222 |
| HSCR1RS_PEA_1_node_54 | 223 |
| HSCR1RS_PEA_1_node_57 | 224 |
| HSCR1RS_PEA_1_node_63 | 225 |
| HSCR1RS_PEA_1_node_65 | 226 |
| HSCR1RS_PEA_1_node_71 | 227 |
| HSCR1RS_PEA_1_node_73 | 228 |
| HSCR1RS_PEA_1_node_79 | 229 |
| HSCR1RS_PEA_1_node_81 | 230 |
| HSCR1RS_PEA_1_node_87 | 231 |
| HSCR1RS_PEA_1_node_89 | 232 |
| HSCR1RS_PEA_1_node_91 | 233 |
| HSCR1RS_PEA_1_node_101 | 234 |
| HSCR1RS_PEA_1_node_0 | 235 |
| HSCR1RS_PEA_1_node_5 | 236 |
| HSCR1RS_PEA_1_node_7 | 237 |
| HSCR1RS_PEA_1_node_8 | 238 |
| HSCR1RS_PEA_1_node_14 | 239 |
| HSCR1RS_PEA_1_node_17 | 240 |
| HSCR1RS_PEA_1_node_23 | 241 |
| HSCR1RS_PEA_1_node_25 | 242 |
| HSCR1RS_PEA_1_node_31 | 243 |
| HSCR1RS_PEA_1_node_33 | 244 |
| HSCR1RS_PEA_1_node_39 | 245 |
| HSCR1RS_PEA_1_node_47 | 246 |
| HSCR1RS_PEA_1_node_50 | 247 |
| HSCR1RS_PEA_1_node_56 | 248 |
| HSCR1RS_PEA_1_node_61 | 249 |
| HSCR1RS_PEA_1_node_67 | 250 |
| HSCR1RS_PEA_1_node_69 | 251 |
| HSCR1RS_PEA_1_node_75 | 252 |
| HSCR1RS_PEA_1_node_77 | 253 |
| HSCR1RS_PEA_1_node_83 | 254 |
| HSCR1RS_PEA_1_node_85 | 255 |
| HSCR1RS_PEA_1_node_93 | 256 |
| HSCR1RS_PEA_1_node_97 | 257 |

TABLE 24

Proteins of interest

| Protein Name | SEQ ID NO: | Protein Length | Corresponding Transcript(s) |
|---|---|---|---|
| HSCR1RS_PEA_1_P13 | 261 | P1570 | HSCR1RS_PEA_1_T5; HSCR1RS_PEA_1_T14 |
| HSCR1RS_PEA_1_P14 | 262 | P584 | HSCR1RS_PEA_1_T9 |
| HSCR1RS_PEA_1_P15 | 263 | P182 | HSCR1RS_PEA_1_T10 |
| HSCR1RS_PEA_1_P17 | 264 | P2020 | HSCR1RS_PEA_1_T13 |

Figure 74:
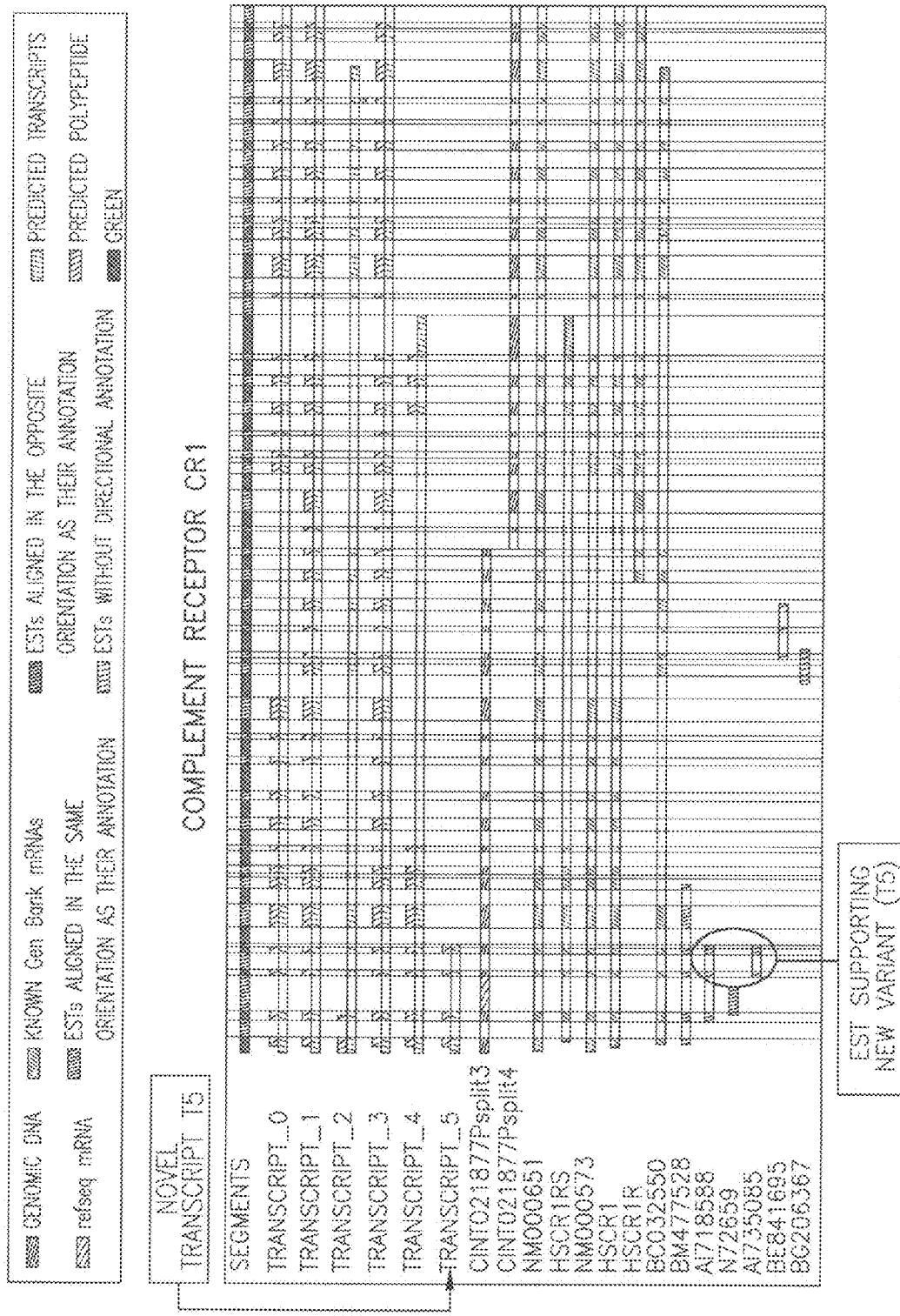
FIG. 74 is a schematic illustration depicting the graphical viewer scheme presenting the new variant of Complement Receptor CR1 (transcript_T5) as compared to the wild type mRNA. The ESTs supporting the new variants are indicated. Transcript indicated as "0" represents known mRNA. The pattern code is as in FIG. 2.
Figure 76:
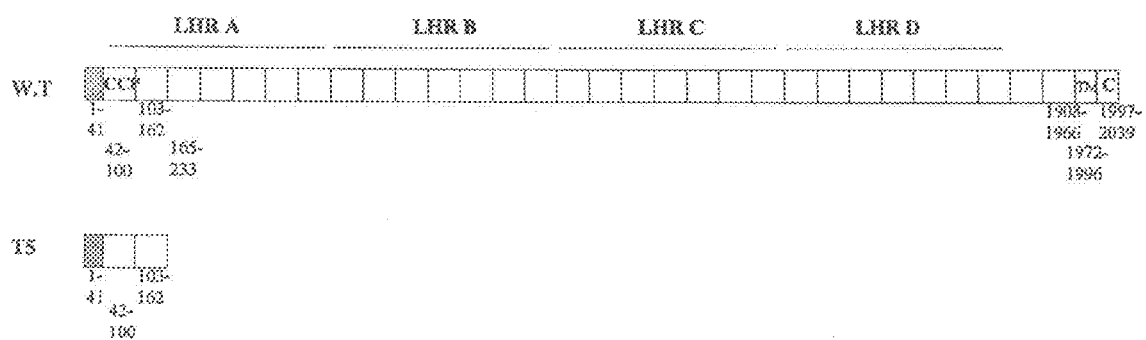
FIG. 76 is a schematic illustration showing the protein domain structure of wild-type Complement Receptor CR1 (SwissProt locus: CR1_HUMAN; SEQ ID NO:148) and the variants of the present invention (SEQ ID NO: 107). Unique regions are indicated (SEQ ID NO:109).

The present inventors uncovered a novel splice variant of Complement Receptor CR1 (SEQ ID NOs:107 and 108; FIGS. 73a-b), variant T5. The T5 splice variant obtained by the alternative splicing of the CR1 gene result in extension of exon 4 leading to an insertion of a stop codon and the generation of a truncated protein (FIGS. 74-76). This splice variant encodes 182 amino acids long protein (SEQ ID NO:107), which contains 162 amino acids of the wild type sequence (GenBank Accession No. P17927; SEQ ID NO:148, and a unique C-terminal sequence of 20 amino acids (SELKYP-FLFLLPTHSNFSLE—SEQ ID NO:109; FIG. 75). It encompasses the two N-terminal CCP domains (also designated sushi domains).

Comparison Report Between HSCR1RS_P6 (SEQ ID NO:107) and CR1_HUMAN (SEQ ID NO:148)

1. An isolated chimeric polypeptide HSCR1RS_P6, comprising a first amino acid sequence being at least 90% homologous to MGASSPRSPEPVGPPAPGLPFC-CGGSLLAVVVLLALPVAWGQCNAPEWLPFA RPTNLT-DEFEFPIGTYLNYECRPGYSGRPFSII-CLKNSVWTGAKDRCRRKSCRN PPDPVNGMVHVIKGIQFGSQIKYSCT-KGYRLIGSSSATCIISGDTVIWDNETPIC D corresponding to amino acids 1-162 of CR1_HUMAN, which also corresponds to amino acids 1-162 of HSCR1RS_P6, and a second amino acid sequence being at least 70%, optionally at least 80%, preferably at least 85%, more preferably at least 90% and most preferably at least 95% homologous to a polypeptide having the sequence SELKYPFLFLLPTHSN-FSLE (SEQ ID NO:109) corresponding to amino acids 163-182 of HSCR1RS_P6, wherein said first amino acid sequence and second amino acid sequence are contiguous and in a sequential order.

2. An isolated polypeptide for a tail of HSCR1RS_P6, comprising a polypeptide being at least 70%, optionally at least about 80%, preferably at least about 85%, more preferably at least about 90% and most preferably at least about 95% homologous to the sequence SELKYPFLFLLPTHSN-FSLE in HSCR1RS_P6.

A more detailed description of these variant proteins and their corresponding nucleic acid sequences is provided below. As noted above, cluster HSCR1RS features 5 transcript(s), which were listed in Table 22 above. These transcript(s) encode for protein(s) which are variant(s) of protein Complement receptor type 1 precursor. Following is a description of each variant protein according to the present invention.

Variant protein HSCR1RS_PEA_1_P13 (SEQ ID NO:261) of the present invention is encoded by transcript(s) HSCR1RS_PEA_1_T5 (SEQ ID NO:206) and HSCR1RS_PEA_1_T14 (SEQ ID NO:210). An alignment of HSCR1RS_PEA_1_P13 with the known protein (Complement receptor type 1 precursor, SEQ ID NO:260) is shown in FIG. 113. One or more alignments to one or more previously published protein sequences are shown in FIGS. 114-116. A brief description of the relationship of the variant protein according to the present invention to each such aligned protein is as follows:

Comparison Report Between HSCR1RS_PEA_P13 and CR1_HUMAN_V4 (SEQ ID NO:260)

1. An isolated chimeric polypeptide HSCR1RS_PEA_1_P13, comprising a first amino acid sequence being at least 90% homologous to MGASSPRSPEPVGPPAPGLPFC-CGGSLLAVVVLLALPVAWGQCNAPEWLPFA RPTNLT-DEFEFPIGTYLNYECRPGYSGRPFSII-CLKNSVWTGAKDRCRRKSCRN PPDPVNGMVHVIKGIQFGSQIKYSCT-KGYRLIGSSSATCIISGDTVIWDNETPIC DRIPCGLPP-TIT corresponding to amino acids 1-173 of CR1_HUMAN_V4 (SEQ ID NO:260), which also corresponds to amino acids 1-173 of HSCR1RS_PEA_1_P13, a second amino acid sequence being at least 90% homologous to NGDFISTNRENFHYGSVVTYRCNPGSG-GRKVFELVGEPSIYCTSNDDQVGIWS GPAPQCIIP-NKCTPPNVENGILVSDNRSLFSLNEVVE-FRCQPGFVMKGPRRVKC QALNKWEPELPSCSRVCQPPPDVL-HAERTQRDKDNFSPGQEVFYSCEPGYDL RGAASM-RCTPQGDWSPAAPTCEVKSCD-DFMGQLLNGRVLFPVNLQLGAKV DFVCDEGFQLKGSSASYCVLAGMESL-WNSSVPVCEQIFCPSPPVIPNGRHTGK PLEVFPFGK-TVNYTCDPHPDRGTSFDLIGESTIRCTS-DPQGNGVWSSPAPRCGI LGHCQAPDHFLFAKLKTQTNASDF-PIGTSLKYECRPEYYGRPFSITCLDNLVW SSPKDVCK-RKSCKTPPDPVNGMVHVITDIQVG-SRINYSCTTGHRLIGHSSAECI LSGNTAHWSTKPPICQRIPCGLPP-TIANGDFISTNRENFHYGSVVTYRCNLGSR GRKVFELVGEPSIYCTSNDDQVGIWSG-PAPQCIIPNKCTPPNVENGILVSDNRS LFSLNEVVE-FRCQPGFVMKGPRRVKCQALNKWEPELP-SCSRVCQPPPEILHGE HTPSHQDNFSPGQEVFYSCEPGYDLR-GAASLHCTPQGDWSPEAPRCAVKSCD DFLGQL-PHGRVLFPLNLQLGAKVSFVCDEGFR-LKGSSVSHCVLVGMRSLWN NSVPVCEHIFCPNPPAILNGRHTGTPSG-DIPYGKEISYTCDPHPDRGMTFNLIGE STIRCTSDPH-GNGVWSSPAPRCELSVRAGHCKTPEQFP-FASPTIPINDFEFPVGT SLNYECRPGYFGKMFSISCLEN-LVWSSVEDNCRRKSCGPPPEPFNGMVHINTD TQFG-STVNYSCNEGFRLIGSPSTTCLVSGN-NVTWDKKAPICEIISCEPPPTISNG DFYSNNRTSFHNGTVVTYQCHTGP-DGEQLFELVGERSIYCTSKDDQVGVWSS PPPRCIST-NKCTAPEVENAIRVPGNRSFFSLTEIIR-FRCQPGFVMVGSHTVQCQT NGRWGPKLPHCSRVCQPPPEILHGE-HTLSHQDNFSPGQEVFYSCEPSYDLRGA ASLHCT-PQGDWSPEAPRCTVKSCDDFLGQL-PHGRVLLPLNLQLGAKVSFVCD EGFRLKGRSASHCVLAGMKALWNSS-VPVCEQIFCPNPPAILNGRHTGTPFGDI PYGKEISY-ACDTHPDRGMTFNLIGESSIRCTSD-PQGNGVWSSPAPRCELSVPA ACPHPPKIQNGHYIGGHVSLYLPGMTI-SYICDPGYLLVGKGFIFCTDQGIWSQL DHYCKEVNC-SFPLFMNGISKELEMKKVY-HYGDYVTLKCEDGYTLEGSPWSQ CQADDRWDPPLAKCTSRAHDALIV corresponding to amino acids 624-1975 of CR1_HUMAN_V4 (SEQ ID NO:260), which also corresponds to amino acids 174-1525 of HSCR1RS_PEA_1_P13 (SEQ ID NO:261), and a third amino acid sequence being at least 70%, optionally at least 80%, preferably at least 85%, more preferably at least 90% and most preferably at least 95% homologous to a polypeptide having the sequence AIMHMKTLKKWLSIY-ILKEAAAFIPELCKQMKKIAGSFLDKVLYS corresponding to amino acids 1526-1570 of HSCR1RS_PEA_1_P13 (SEQ ID NO:261), wherein said first amino acid sequence, second amino acid sequence and third amino acid sequence are contiguous and in a sequential order.

2. An isolated chimeric polypeptide for an edge portion of HSCR1RS_PEA_1_P13, comprising a polypeptide having "n" amino acids, wherein "n" is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TN, having a structure as follows: a sequence starting from any of amino acid numbers 173-x to 173; and ending at any of amino acid numbers 174+((n−2)−x), in which x varies from 0 to n−2.

3. An isolated polypeptide for a tail of HSCR1RS_PEA_1_P13, comprising a polypeptide being at least 70%, optionally at least about 80%, preferably at least about 85%, more preferably at least about 90% and most preferably at least about 95% homologous to the sequence AIMHMK-TLKKWLSIYILKEAAAFIPELCKQMKKI-AGSFLDKVLYS in HSCR1RS_PEA_1_P13.

It should be noted that the known protein sequence (CR1_HUMAN—SEQ ID NO:148) has one or more changes compared to CR1_HUMAN_V4 (SEQ ID NO:260). These changes were previously known to occur and are listed in Table 25, hereinbelow.

TABLE 25

Changes to CR1_HUMAN_V4 (SEQ ID NO: 260)

| SNP position(s) on amino acid sequence | Type of change |
|---|---|
| 895 | Public SNP replace |
| 1877 | Conflict |

The location of the variant protein was determined according to results from a number of different software programs and analyses, including analyses from SignalP and other specialized programs. The HSCR1RS_PEA_1_P13 variant protein is expected to be secreted protein based on the prediction of both a signal-peptide and the absence of a trans-membrane region Variant protein HSCR1RS_PEA_1_P13 also has the following non-silent SNPs (Single Nucleotide Polymorphisms) as listed in Table 26, given according to their position(s) on the amino acid sequence, with the alternative amino acid(s) listed; the last column indicates whether the SNP is known or not; the presence of known SNPs in variant protein HSCR1RS_PEA_1_P13 (SEQ ID NO:261) sequence provides support for the deduced sequence of this variant protein according to the present invention.

TABLE 26

Amino acid substitutions

| SNP position(s) on amino acid sequence | Alternative amino acid(s) | Previously known SNP? |
|---|---|---|
| 105 | R → C | Yes |
| 115 | V → A | Yes |
| 445 | T → A | Yes |
| 758 | H → R | Yes |
| 958 | T → M | Yes |
| 1160 | S → T | Yes |
| 1165 | I → V | Yes |
| 1377 | P → R | Yes |
| 1426 | I → T | No |
| 1519 | A → T | Yes |

Table 27, hereinbelow, presents the protein domain of HSCR1RS_PEA_1_P13 (SEQ ID NO:261) as determined by using InterPro.

TABLE 27

InterPro domain(s)

| InterPro ID | Domain description | Analysis type | Position(s) on protein |
|---|---|---|---|
| IPR000436 | Sushi domain/SCR domain/CCP module | HMMPfam | 1007-1064, 104-161, 1069-1135, 1141-1196, 1200-1256, 1261-1319, 1324-1390, 1398-1454, 1459-1515, 166-232, 238-293, 297-353, 358-416, 421-487, 43-99, 493-549, 554-611, 616-682, 688-743, 747-803, 808-866, 871-937, 946-1002 |
| IPR000436 | Sushi domain/SCR domain/CCP module | HMMSmart | 1007-1064, 104-161, 1069-1135, 1141-1196, 1200-1256, 1261-1319, 1324-1390, 1398-1454, 1459-1515, 166-232, 238-293, 297-353, 358-416, 421-487, 43-99, 493-549, 554-611, 616-682, |

TABLE 27-continued

| InterPro domain(s) | | | |
|---|---|---|---|
| InterPro ID | Domain description | Analysis type | Position(s) on protein |
| IPR000834 | Peptidase M14, carboxypeptidase A | ScanRegExp | 688-743, 747-803, 808-866, 871-937, 946-1002 432-442 |

Variant Protein HSCR1RS_PEA_P13

Variant protein HSCR1RS_PEA_1_P13 (SEQ ID NO:261) is encoded by the following transcript(s): HSCR1RS_PEA_1_T5 (SEQ ID NO:206) and HSCR1RS_PEA_1_T14 (SEQ ID NO:210).

The coding portion of transcript HSCR1RS_PEA_1_T5 (SEQ ID NO:206) starts at position 112 and ends at position 4821. The HSCR1RS_PEA_1_T5 transcript also has the following SNPs as listed in Table 28, given according to their position on the nucleotide sequence, with the alternative nucleic acid listed; the last column indicates whether the SNP is known or not; the presence of known SNPs in variant protein HSCR1RS_PEA_1_P13 sequence provides support for the deduced sequence of this variant protein according to the present invention.

TABLE 28

| Nucleic acid SNPs | | |
|---|---|---|
| SNP position on nucleotide sequence | Alternative nucleic acid | Previously known SNP? |
| 78 | A → G | No |
| 79 | T → A | No |
| 201 | T → C | Yes |
| 213 | T → C | Yes |
| 291 | A → G | Yes |
| 424 | C → T | Yes |
| 455 | T → C | Yes |
| 456 | G → A | Yes |
| 1440 | G → A | Yes |
| 1444 | A → G | Yes |
| 1473 | A → G | Yes |
| 2384 | A → G | Yes |
| 2984 | C → T | Yes |
| 3015 | C → T | Yes |
| 3589 | T → A | Yes |
| 3604 | A → G | Yes |
| 4241 | C → G | Yes |
| 4388 | T → C | No |
| 4666 | G → A | Yes |
| 5299 | A → G | Yes |
| 5303 | G → T | Yes |
| 5324 | → C | No |
| 5596 | G → C | No |
| 5597 | C → G | No |
| 5652 | T → C | Yes |
| 5688 | G → T | Yes |
| 5777 | T → C | Yes |

The coding portion of transcript HSCR1RS_PEA_1_T14 (SEQ ID NO:210) starts at position 112 and ends at position 4821. The HSCR1RS_PEA_1_T14 transcript also has the following SNPs as listed in Table 29, given according to their position on the nucleotide sequence, with the alternative nucleic acid listed; the last column indicates whether the SNP is known or not; the presence of known SNPs in variant protein HSCR1RS_PEA_1_P13 sequence provides support for the deduced sequence of this variant protein according to the present invention.

TABLE 29

| Nucleic acid SNPs | | |
|---|---|---|
| SNP position on nucleotide sequence | Alternative nucleic acid | Previously known SNP? |
| 78 | A → G | No |
| 79 | T → A | No |
| 201 | T → C | Yes |
| 213 | T → C | Yes |
| 291 | A → G | Yes |
| 424 | C → T | Yes |
| 455 | T → C | Yes |
| 456 | G → A | Yes |
| 1440 | G → A | No |
| 1444 | A → G | No |
| 2384 | A → G | Yes |
| 2984 | C → T | Yes |
| 3015 | C → T | Yes |
| 3589 | T → A | Yes |
| 3604 | A → G | Yes |
| 4241 | C → G | Yes |
| 4388 | T → C | No |
| 4666 | G → A | Yes |
| 5299 | A → G | Yes |
| 5303 | G → T | Yes |
| 5324 | → C | No |
| 5596 | G → C | No |
| 5597 | C → G | No |
| 5652 | T → C | Yes |
| 5688 | G → T | Yes |
| 5777 | T → C | Yes |

Variant Protein HSCR1RS_PEA_1_P14

Variant protein HSCR1RS_PEA_1_P14 (SEQ ID NO:262) is encoded by transcript HSCR1RS_PEA_1_T9 (SEQ ID NO:207). FIG. 114 presents an alignment of HSCR1RS_PEA_1_P14 (SEQ ID NO:262) with the known protein (Complement receptor type 1 precursor; SEQ ID NO:148). One or more alignments to one or more previously published protein sequences are shown in FIGS. 113, 115, and 116. A brief description of the relationship of the variant protein according to the present invention to each such aligned protein is as follows:

Comparison Report Between HSCR1RS_PEA_1_P14 (SEQ ID NO:262) and CR1_HUMAN (SEQ ID NO:148)

1. An isolated chimeric polypeptide HSCR1RS_PEA_1_P14, comprising a first amino acid sequence being at least 90% homologous to MGASSPRSPEPVGPPAPGLPFC-CGGSLLAVVVLLALPVAWGQCNAPEWLPFA RPTNLT-DEFEFPIGTYLNYECRPGYSGRPFSII-CLKNSVWTGAKDRCRRKSCRN PPDPVNGMVHVIKGIQFGSQIKYSCT-KGYRLIGSSSATCIISGDTVIWDNETPIC DRIPCGLPP-TITNGDFISTNRENFHYGSVVTYRCN-PGSGGRKVFELVGEPSIYC TSNDDQVGIWSGPAPQCIIPNKCTPPN-VENGILVSDNRSLFSLNEVVEFRCQPG FVMKG-PRRVKCQALNKWEPELPSCSRVCQPPPD- VLHAERTQRDKDNFSPGQE VFYSCEPGYDLRGAASMRCTPQGDWS- PAAPTCEVKSCDDFMGQLLNGRVLF PVNLQL- GAKVDFVCDEGFQLKGSSASYCVLAG- MESLWNSSVPVCEQIFCPSP PVIPNGRHTGKPLEVFPFGKAVNYTCD- PHPDRGTSFDLIGESTIRCTSDPQGNG VWSSPA- PRCGILGHCQAPDHFLFAKLKTQTNASD- FPIGTSLKYECRPEYYGRP FSITCLDNLVWSSPKDVCKRKSCKTPPD- PVNGMVHVITDIQVGSRINYSCTTG corresponding to amino acids 1-584 of CR1_HUMAN (SEQ ID NO:148), which also corresponds to amino acids 1-584 of HSCR1RS_PEA__1_P14 (SEQ ID NO:262).

The location of the variant protein was determined according to results from a number of different software programs and analyses, including analyses from SignalP and other specialized programs. The variant protein is believed to be a secreted protein due to the prediction of a signal-peptide and the absence of a trans-membrane region.

Variant protein HSCR1RS_PEA__1_P14 also has the following non-silent SNPs (Single Nucleotide Polymorphisms) as listed in Table 31, given according to their position(s) on the amino acid sequence, with the alternative amino acid(s) listed; the last column indicates whether the SNP is known or not; the presence of known SNPs in variant protein HSCR1RS_PEA__1_P14 sequence provides support for the deduced sequence of this variant protein according to the present invention.

TABLE 30

Amino acid mutations

| SNP position(s) on amino acid sequence | Alternative amino acid(s) | Previously known SNP? |
|---|---|---|
| 105 | R → C | Yes |
| 115 | V → A | Yes |

The glycosylation sites of variant protein HSCR1RS_PEA__1_P14, as compared to the known protein Complement receptor type 1 precursor, are described in Table 31 given according to their position(s) on the amino acid sequence in the first column; the second column indicates whether the glycosylation site is present in the variant protein; and the last column indicates whether the position is different on the variant protein.

TABLE 31

Glycosylation site(s)

| Position(s) on known amino acid sequence | Present in variant protein? | Position in variant protein? |
|---|---|---|
| 1605 | NO | |
| 1534 | NO | |
| 56 | YES | 56 |
| 1481 | NO | |
| 1540 | NO | |
| 578 | YES | 578 |
| 1908 | NO | |
| 1763 | NO | |
| 860 | NO | |
| 959 | NO | |
| 1028 | NO | |
| 897 | NO | |
| 252 | YES | 252 |
| 1152 | NO | |
| 410 | YES | 410 |

TABLE 31-continued

Glycosylation site(s)

| Position(s) on known amino acid sequence | Present in variant protein? | Position in variant protein? |
|---|---|---|
| 702 | NO | |
| 509 | YES | 509 |
| 1504 | NO | |
| 1310 | NO | |
| 447 | YES | 447 |

The phosphorylation sites of variant protein HSCR1RS_PEA__1_P14, as compared to the known protein Complement receptor type 1 precursor, are described in Table 32 given according to their position(s) on the amino acid sequence in the first column; the second column indicates whether the phosphorylation site is present in the variant protein; and the last column indicates whether the position is different on the variant protein.

TABLE 32

Phosphorylation site(s)

| Position(s) on known amino acid sequence | Present in variant protein? | Position in variant protein? |
|---|---|---|
| 42 | yes | 42 |

The HSCR1RS_PEA__1_P14 variant protein has the following domains, as determined by using InterPro. The domains are described in Table 33, hereinbelow.

TABLE 33

InterPro domain(s)

| InterPro ID | Domain description | Analysis type | Position(s) on protein |
|---|---|---|---|
| IPR000436 | Sushi domain/SCR domain/CCP module | HMMPfam | 104-161, 166-232, 238-293, 297-353, 358-416, 421-487, 43-99, 493-549 |
| IPR000436 | Sushi domain/SCR domain/CCP module | HMMSmart | 104-161, 166-232, 238-293, 297-353, 358-416, 421-487, 43-99, 493-549 |
| IPR000834 | Peptidase M14, carboxypeptidase A | ScanRegExp | 432-442 |

Variant protein HSCR1RS_PEA__1_P14 (SEQ ID NO:262) is encoded by HSCR1RS_PEA__1_T9 (SEQ ID NO:207). The coding portion of transcript HSCR1RS_PEA__1_T9 (SEQ ID NO:207) starts at position 112 and ends at position 1863. The HSCR1RS_PEA__1_T9 transcript also has the following SNPs as listed in Table 34 given according to their position on the nucleotide sequence, with the alternative nucleic acid listed; the last column indicates whether the SNP is known or not; the presence of known SNPs in variant protein HSCR1RS_PEA__1_P14 sequence provides support for the deduced sequence of this variant protein according to the present invention.

TABLE 34

Nucleic acid SNPs

| SNP position on nucleotide sequence | Alternative nucleic acid | Previously known SNP? |
|---|---|---|
| 78 | A → G | No |
| 79 | T → A | No |
| 201 | T → C | Yes |
| 213 | T → C | Yes |
| 291 | A → G | Yes |
| 424 | C → T | Yes |
| 455 | T → C | Yes |
| 456 | G → A | Yes |

Variant Protein HSCR1RS_PEA_P15

Variant protein HSCR1RS_PEA_1_P15 (SEQ ID NO:263) according to the present invention is encoded by transcript HSCR1RS_PEA_1_T10 (SEQ ID NO:208). FIG. 115 depicts an alignment of HSCR1RS_PEA_1_P15 to the known protein (Complement receptor type 1 precursor; SEQ ID NO:148). One or more alignments to one or more previously published protein sequences are given in FIGS. 113, 114, and 116. A brief description of the relationship of the variant protein according to the present invention to each such aligned protein is as follows:

Comparison Report Between HSCR1RS_PEA_P15 and CR1_HUMAN

1. An isolated chimeric polypeptide HSCR1RS_PEA_1_P15, comprising a first amino acid sequence being at least 90% homologous to MGASSPRSPEPVGPPAPGLPFCCGGSLLAVVVLLALPVAWGQCNAPEWLPFARPTNLT-DEFEFPIGTYLNYECRPGYSGRPFSII-CLKNSVWTGAKDRCRRKSCRN PPDPVNGMVHVIKGIQFGSQIKYSCT-KGYRLIGSSSATCIISGDTVIWDNETPIC D corresponding to amino acids 1-162 of CR1_HUMAN (SEQ ID NO:148), which also corresponds to amino acids 1-162 of HSCR1RS_PEA_1_P15 (SEQ ID NO:263), and a second amino acid sequence being at least 70%, optionally at least 80%, preferably at least 85%, more preferably at least 90% and most preferably at least % homologous to a polypeptide having the sequence SELKYPFLFLLPTHSNFSLE (SEQ ID NO:654) corresponding to amino acids 163-182 of HSCR1RS_PEA_1_P15, wherein said first amino acid sequence and second amino acid sequence are contiguous and in a sequential order.

2. An isolated polypeptide for a tail of HSCR1RS_PEA_1_P15, comprising a polypeptide being at least 70%, optionally at least about 80%, preferably at least about 85%, more preferably at least about 90% and most preferably at least about 95% homologous to the sequence SELKYPFLFLLPTHSNFSLE (SEQ ID NO:654) in HSCR1RS_PEA_1_P15.

The location of the variant protein was determined according to results from a number of different software programs and analyses, including analyses from SignalP and other specialized programs. The variant protein is believed to be a secreted protein based on the prediction of a signal peptide and the absence of a trans-membrane region.

Variant protein HSCR1RS_PEA_1_P15 also has the following non-silent SNPs (Single Nucleotide Polymorphisms) as listed in Table 35, given according to their position(s) on the amino acid sequence, with the alternative amino acid(s) listed; the last column indicates whether the SNP is known or not; the presence of known SNPs in variant protein HSCR1RS_PEA_1_P15 sequence provides support for the deduced sequence of this variant protein according to the present invention).

TABLE 35

Amino acid mutations

| SNP position(s) on amino acid sequence | Alternative amino acid(s) | Previously known SNP? |
|---|---|---|
| 105 | R → C | Yes |
| 115 | V → A | Yes |

The glycosylation sites of variant protein HSCR1RS_PEA_1_P15, as compared to the known protein Complement receptor type 1 precursor, are described in Table 36 given according to their position(s) on the amino acid sequence in the first column; the second column indicates whether the glycosylation site is present in the variant protein; and the last column indicates whether the position is different on the variant protein.

TABLE 36

Glycosylation site(s)

| Position(s) on known amino acid sequence | Present in variant protein? | Position in variant protein? |
|---|---|---|
| 1605 | NO | |
| 1534 | NO | |
| 56 | YES | 56 |
| 1481 | NO | |
| 1540 | NO | |
| 578 | NO | |
| 1908 | NO | |
| 1763 | NO | |
| 860 | NO | |
| 959 | NO | |
| 1028 | NO | |
| 897 | NO | |
| 252 | NO | |
| 1152 | NO | |
| 410 | NO | |
| 702 | NO | |
| 509 | NO | |
| 1504 | NO | |
| 1310 | NO | |
| 447 | NO | |

The phosphorylation sites of variant protein HSCR1RS_PEA_1_P15, as compared to the known protein Complement receptor type 1 precursor, are described in Table 37 given according to their position(s) on the amino acid sequence in the first column; the second column indicates whether the phosphorylation site is present in the variant protein; and the last column indicates whether the position is different on the variant protein.

TABLE 37

Phosphorylation site(s)

| Position(s) on known amino acid sequence | Present in variant protein? | Position in variant protein? |
|---|---|---|
| 42 | yes | 42 |

The variant protein has the following domains, as determined by using InterPro and presented in Table 38 hereinbelow.

TABLE 38

| InterPro domain(s) | | | |
|---|---|---|---|
| InterPro ID | Domain description | Analysis type | Position(s) on protein |
| IPR000436 | Sushi domain/SCR domain/CCP module | HMMPfam | 104-161, 43-99 |
| IPR000436 | Sushi domain/SCR domain/CCP module | HMMSmart | 104-161, 43-99 |

Variant protein HSCR1RS_PEA_1_P15 is encoded by the following transcript: HSCR1RS_PEA_1_T10 (SEQ ID NO:208). The coding portion of transcript HSCR1RS_PEA_1_T10 (SEQ ID NO:208) starts at position 112 and ends at position 657. The transcript also has the following SNPs as listed in Table 39 given according to their position on the nucleotide sequence, with the alternative nucleic acid listed; the last column indicates whether the SNP is known or not; the presence of known SNPs in variant protein HSCR1RS_PEA_1_P15 sequence provides support for the deduced sequence of this variant protein according to the present invention.

TABLE 39

| Nucleic acid SNPs | | |
|---|---|---|
| SNP position on nucleotide sequence | Alternative nucleic acid | Previously known SNP? |
| 78 | A → G | No |
| 79 | T → A | No |
| 201 | T → C | Yes |
| 213 | T → C | Yes |
| 291 | A → G | Yes |
| 424 | C → T | Yes |
| 455 | T → C | Yes |
| 456 | G → A | Yes |

Variant Protein HSCR1RS_PEA_1_P17

Variant protein HSCR1RS_PEA_1_P17 (SEQ ID NO:264) is encoded by transcript HSCR1RS_PEA_1_T13 (SEQ ID NO:209). FIG. 116 presents an alignment of HSCR1RS_PEA_1_P17 to the known protein (Complement receptor type 1 precursor; SEQ ID NO:259). One or more alignments to one or more previously published protein sequences are given in FIGS. 113-115. A brief description of the relationship of the variant protein according to the present invention to each such aligned protein is as follows.

Comparison Report Between HSCR1RS_PEA_1_P17 and CR1_HUMAN_V1 (SEQ ID NO:259)

1. An isolated chimeric polypeptide HSCR1RS_PEA_1_P17, comprising a first amino acid sequence being at least 90% homologous to MGASSPRSPEPVGPPAPGLPFC-CGGSLLAVVVLLALPVAWGQCNAPEWLPFA RPTNLT-DEFEFPIGTYLNYECRPGYSGRPFSII-CLKNSVWTGAKDRCRRKSCRN PPDPVNGMVHVIKGIQFGSQIKYSCT-KGYRLIGSSSATCIISGDTVIWDNETPIC DRIPCGLPP-TITNGDFISTNRENFHYGSVVTYRCN-PGSSGGRKVFELVGEPSIYC TSNDDQVGIWSGPAPQCIIPNKCTPPN-VENGILVSDNRSLFSLNEVVEFRCQPG FVMKG-PRRVKCQALNKWEPELPSCSRVCQPPPD-VLHAERTQRDKDNFSPGQE VFYSCEPGYDLRGAASMRCTPQGDWS-PAAPTCEVKSCDDFMGQLLNGRVLF PVNLQL-GAKVDFVCDEGFQLKGSSASYCVLAG-MESLWNSSVPVCEQIFCPSP PVIPNGRHTGKPLEVFPFGK corresponding to amino acids 1-444 of CR1_HUMAN_V1, which also corresponds to amino acids 1-444 of HSCR1RS_PEA_1_P17 (SEQ ID NO:264), a bridging amino acid T corresponding to amino acid 445 of HSCR1RS_PEA_1_P17, a second amino acid sequence being at least 90% homologous to VNYTCDPHP-DRGTSFDLIGESTIRCTSDPQGNGVWSS-PAPRCGILGHCQAPDH FLFAKLKTQTNASDF-PIGTSLKYECRPEYYGRPFSITCLDNLVWSSPKDVCKR KSCKTPPDPVNGMVHVITDIQVGSRINY-SCTTGHRLIGHSSAECILSGNAAHW STKPPIC-QRIPCGLPPTIANGDFISTNRENFHYGS-VVTYRCNPGSGGRKVFELV GEPSIYCTSNDDQVGIWSGPAPQCIIP-NKCTPPNVENGILVSDNRSLFSLNEVVE FRCQPG-FVMKGPRRVKCQALNKWEPELPSCSRVC-QPPPDVLHAERTQRDKD NFSPGQEVFYSCEPGYDLRGAASMRCT-PQGDWSPAAPTCEVKSCDDFMGQL LNGRVLFPVN-LQLGAKVDFVCDEGFQLKGSSASYCV-LAGMESLWNSSVPVC EQIFCPSPPVIPNGRHTGKPLEVFPF-GKAVNYTCDPHPDRGTSFDLIGESTIRCT SDPQGNGVWSSPAPRCGILGHCQAPDH-FLFAKLKTQTNASDFPIGTSLKYECR PEYYGRPFSIT-CLDNLVWSSPKDVCKRKSCKTPPDPVNG-MVHVITDIQVGSRI NYSCTTGHRLIGHSSAECILSGNTAHW-STKPPICQRIPCGLPPTIANGDFISTNR ENFHYGSV-VTYRCNLGSR-GRKVFELVGEPSIYCTSNDDQVGIWSGPAPQCIIP NKCTPPNVENGILVSDNRSLFSLNEVVE-FRCQPGFVMKGPRRVKCQALNKWE PELPSCSRVC-QPPPEILHGEHTPSHQDNFSPGQEVFY-SCEPGYDLRGAASLHCT PQGDWSPEAPRCAVKSCDDFLGQL-PHGRVLFPLNLQLGAKVSFVCDEGFRLK GSSVSHCV-LVGMRSLWNNSVPVCEHIFCPNPPAILN-GRHTGTPSGDIPYGKEIS YTCDPHPDRGMTFNLIGESTIRCTSDPH-GNGVWSSPAPRCELSVRAGHCKTPE QFPFASPTIPIN-DFEFPVGTSLNYECRPGYFGKMFSIS-CLENLVWSSVEDNCRR KSCGPPPEPFNGMVHINTDTQFGSTVNY-SCNEGFRLIGSPSTTCLVSGNNVTW DKKAPICEIIS-CEPPPTISNGDFYSNNRTSFHNGTV-VTYQCHTGPDGEQLFELV GERSIYCTSKDDQVGVWSSPPPRCIST-NKCTAPEVENAIRVPGNRSFFSLTEIIR FRCQPGFVM-VGSHTVQCQTNGRWGPKLPHCSRVCQP-PPEILHGEHTLSHQDN FSPGQEVFYSCEPSYDLRGAASLHCT-PQGDWSPEAPRCTVKSCDDFLGQLPH GRVLLPLN-LQLGAKVSFVCDEGFRLKGRSASHCV-LAGMKALWNSSVPVCEQI FCPNPPAILNGRHTGTPFGDIPYGKEI-SYACDTHPDRGMTFNLIGESSIRCTSDP QGNGVWSS-PAPRCELSVPAACPHPPKIQNGHYIGGH-VSLYLPGMTISYICDPG YLLVGKGFIFCTDQGIWSQLDHYCK-EVNCSFPLFMNGISKELEMKKVYHYGD YVTLKCEDGYTLEGSPWSQCQADDRWDP-PLAKCTSRAHDALIV corresponding to amino acids 446-1975 of CR1_HUMAN_V1 (SEQ ID NO:259), which also corresponds to amino acids 446-1975 of HSCR1RS_PEA_1_P17 (SEQ ID NO:264), and a third amino acid sequence being at least 70%, optionally at least 80%, preferably at least 85%, more preferably at least 90% and most preferably at least 95% homologous to a polypeptide having the sequence AIMHMKTLKKWLSIYILKEAAAFIPEL-CKQMKKIAGSFLDKVLYS corresponding to amino acids 1976-2020 of HSCR1RS_PEA__1_P17, wherein said first amino acid sequence, bridging amino acid, second amino acid sequence and third amino acid sequence are contiguous and in a sequential order.

2. An isolated polypeptide for a tail of HSCR1RS_PEA__1_P17, comprising a polypeptide being at least 70%, optionally at least about 80%, preferably at least about 85%, more preferably at least about 90% and most preferably at least about 95% homologous to the sequence AIMHMK-TLKKWLSIYILKEAAAFIPELCKQMKKI-AGSFLDKVLYS (SEQ ID NO:655) in HSCR1RS_PEA__1_P17.

It should be noted that the known protein sequence (CR1_HUMAN—SEQ ID NO:148) has one or more changes compared to CR1_HUMAN_V1 (SEQ ID NO:259). These changes were previously known to occur and are listed in Table 40, hereinbelow.

TABLE 40

Changes to CR1_HUMAN_V1

| SNP position(s) on amino acid sequence | Type of change |
|---|---|
| 1877 | Conflict |

The location of the variant protein was determined according to results from a number of different software programs and analyses, including analyses from SignalP and other specialized programs. The variant protein is predicted to be secreted based on the prediction of a signal-peptide and the absence of a trans-membrane region.

Variant protein HSCR1RS_PEA__1_P17 also has the following non-silent SNPs (Single Nucleotide Polymorphisms) as listed in Table 41, given according to their position(s) on the amino acid sequence, with the alternative amino acid(s) listed; the last column indicates whether the SNP is known or not; the presence of known SNPs in variant protein HSCR1RS_PEA__1_P17 sequence provides support for the deduced sequence of this variant protein according to the present invention.

TABLE 41

Amino acid substitutions

| SNP position(s) on amino acid sequence | Alternative amino acid(s) | Previously known SNP? |
|---|---|---|
| 105 | R → C | Yes |
| 115 | V → A | Yes |
| 445 | T → A | No |
| 1208 | H → R | Yes |
| 1408 | T → M | Yes |
| 1610 | S → T | Yes |
| 1615 | I → V | Yes |
| 1827 | P → R | Yes |
| 1876 | I → T | No |
| 1969 | A → T | Yes |

The HSCR1RS_PEA__1_P17 variant protein has the following domains, as determined by using InterPro and presented in Table 42, hereinbelow.

TABLE 42

InterPro domain(s)

| InterPro ID | Domain description | Analysis type | Position(s) on protein |
|---|---|---|---|
| IPR000436 | Sushi domain/SCR domain/CCP module | HMMPfam | 1004-1061, 104-161, 1066-1132, 1138-1193, 1197-1253, 1258-1316, 1321-1387, 1396-1452, 1457-1514, 1519-1585, 1591-1646, 1650-1706, 166-232, 1711-1769, 1774-1840, 1848-1904, 1909-1965, 238-293, 297-353, 358-416, 421-487, 43-99, 493-549, 554-611, 616-682, 688-743, 747-803, 808-866, 871-937, 943-999 |
| IPR000436 | Sushi domain/SCR domain/CCP module | HMMSmart | 1004-1061, 104-161, 1066-1132, 1138-1193, 1197-1253, 1258-1316, 1321-1387, 1396-1452, 1457-1514, 1519-1585, 1591-1646, 1650-1706, 166-232, 1711-1769, 1774-1840, 1848-1904, 1909-1965, 238-293, 297-353, 358-416, 421-487, 43-99, 493-549, 554-611, 616-682, 688-743, 747-803, 808-866, 871-937, 943-999 |
| IPR000834 | Peptidase M14, carboxy-peptidase A | ScanRegExp | 432-442, 882-892 |

Variant protein HSCR1RS_PEA__1_P17 is encoded by the following transcript: HSCR1RS_PEA__1_T13 (SEQ ID NO:209). The coding portion of transcript HSCR1RS_PEA__1_T13 (SEQ ID NO:209) starts at position 112 and ends at position 6171. The transcript also has the following SNPs as listed in Table 43 given according to their position on the nucleotide sequence, with the alternative nucleic acid listed; the last column indicates whether the SNP is known or not; the presence of known SNPs in variant protein HSCR1RS_PEA__1_P17 sequence provides support for the deduced sequence of this variant protein according to the present invention.

TABLE 43

Nucleic acid SNPs

| SNP position on nucleotide sequence | Alternative nucleic acid | Previously known SNP? |
|---|---|---|
| 78 | A → G | No |
| 79 | T → A | No |
| 201 | T → C | Yes |
| 213 | T → C | Yes |
| 291 | A → G | Yes |
| 424 | C → T | Yes |
| 455 | T → C | Yes |
| 456 | G → A | Yes |
| 1440 | G → A | No |
| 1444 | A → G | No |
| 3734 | A → G | Yes |
| 4334 | C → T | Yes |
| 4365 | C → T | Yes |
| 4939 | T → A | Yes |
| 4954 | A → G | Yes |
| 5591 | C → G | Yes |
| 5738 | T → C | No |

TABLE 43-continued

Nucleic acid SNPs

| SNP position on nucleotide sequence | Alternative nucleic acid | Previously known SNP? |
|---|---|---|
| 6016 | G → A | Yes |
| 6649 | A → G | Yes |
| 6653 | G → T | Yes |
| 6674 | → C | No |
| 6946 | G → C | No |
| 6947 | C → G | No |
| 7002 | T → C | Yes |
| 7038 | G → T | Yes |
| 7127 | T → C | Yes |

Therapeutic Applications for the CR1 Splice Variant of the Present Invention

Since splice variant T5 (SEQ ID NO:206) of the CR1 encodes a truncated protein that contains only the two N-terminal CCPs (CCPS 1,2), to which binding activity of C4b is attributed, it is predicted to bind C4b and to inhibit complement activation by preventing the assembly of C3 convertases. Indeed, works by Krych and colleagues demonstrated that a truncated CR1 containing only LHR A (CCPs 1-3) prevents hemolysis induced by the classical pathway C3 convertase. The inhibition of hemolysis is referred to the DAA possessed by CR1. In such assays, LHR A possesses 60-100% DAA relative to sCR1. This inhibitory activity was attributed to LHR A only when classical pathway C3 convertase was assayed but not for alternative pathway C3 convertase (which is composed of C3b and Bb rather then C2b and C4b in the classical pathway). Altogether, these data indicate that the CR1 splice variant discussed here might inhibit classical pathway complement activation.

A soluble form of the full-length receptor (sCR1) has been widely described as an antagonist for complement activation. Moreover, antagonists for CR1 are reported to be on phase II clinical trials in treatment of reperfusion injury, respiratory distress syndrome, rheumatoid arthritis and general transplant rejection.

Thus, the present inventors uncovered a therapeutic agent which can be used to: inhibit complement activation by preventing the assembly of C3 convertases and thus treat disorders, disease or conditions such as reperfusion injury, respiratory distress syndrome, rheumatoid arthritis and general transplant rejection. Such an agent is a polypeptide homologous to SEQ ID NO:107, and/or a polynucleotide homologous to SEQ ID NO:108 or 206.

It will be appreciated that such an agent can be administered or provided to an individual in need thereof per se or as part of a pharmaceutical composition with a pharmaceutical acceptable carrier (e.g., PEG and liposomes).

Example 26

Splice Variant of Complement Cis Component Precursor (C1 Esterase)

Background

The classical pathway of complement activation is initiated by the first component of the complement system, C1. C1 is a multimolecular enzyme complex resulting from the noncovalent association of two distinct entities: the recognition protein C1q, and the catalytic subunit, which is a $Ca^{2+}$ dependent tetramer: C1s-C1r-C1r-C1s. C1s and C1r are the proteases responsible for the activation of proteolytic activity of the C1 complex of complement. They share a similar overall structural organization and are composed of five nonenzymatic protein modules (two CUB modules surrounding a single EGF module, and a pair of CCP modules) followed by a serine protease domain. The N-terminal region of both proteases possess high affinity binding site for $Ca^{2+}$ ions which enables them to associate with each other within the tetramer, and to interact with C1q upon C1 assembly.

The role of C1s incorporated in the C1 complex is to mediate the proteolitic function of C1, i.e. to cleave first C4 and then C2 during complement activation. These cleavages occur in a cascade in which active C1s cleaves C4 (to generate C4a and C4b), thus exposes a reactive group on C4b that allows it to bind covalently to the pathogen surface. C4b then binds C2, making it susceptible to cleavage by C1s. The cleavage of C2 results in the formation of C2a and C2b. A complex composed of C2b and C4b generates C3 convertase. In the classical pathway, C2b is the active protease component of C3 convertase, however, C3 convertase is also formed (by other proteins) in the other pathways of complement activation. C3 convertase cleaves many molecules of C3 to produce C3a and C3b. In the MB-lectin pathway, C3b binds to the bacteria cell membrane, thus opsonizes the bacteria and enables phagocytes to internalize them, while C3a serves as an inflammatory mediator. A complex composed of C3b and C3 convertase (=C4b+C2b) acts as C5 convertase. C5 binds this complex through C3b and its cleavage generates C5b and C5a. C5a serves as a powerful peptide mediator of inflammation, while C5b triggers the late events of complement activation, in which the terminal components of complement assemble into membrane-attack complex that can damage certain pathogens.

Clinical Application

Unwanted or uncontrolled activation of C1s can contribute to the pathogenesis of several diseases. The harmful effect of complement activation is suspected in the inflammatory events occurring in ischemia and reperfusion. It has been demonstrated that mice which are homozygous deficient in C3 or C4 were equally protected against reperfusion injury. In addition, C1s inhibitors are being synthesized for therapeutic use in cardiovascular diseases. Hereditary angioedema (HAE) result from deficient function or depletion of the C1 inhibitor. Accordingly, C1s inhibitors are at phase II in treatment of this disease. Uncontrolled activation of C1s could also account for neurodegenerative diseases in the CNS. For example, abnormal levels of C1s are expressed by pyramidal neurons and senile plaques of Alzheimer patients. There are also possible implications of C1s in non-complement related diseases; Human C1s is also implicated in the cleavage of type I and type II collagens. It was hypothesized therefore that C1s participates in the metabolism of cartilage matrix and possibly in the pathogenesis of rheumatoid arthritis and downregulation of the immune response. In addition, C1s can cleave insulin-like growth factor-binding protein-5 (IGFBP-5). IGFBP-5 regulates the action of insulin-like growth factor-I (IGF-I) through tight binding. The cleavage of IGFBP-5 by C1s result in the release of IGF-I to receptors. IGF-I release occurs as a result of acute complement activation during injury and contribute to tissue repair. Thus, this phenomenon could represent a linkage between inflammation and subsequent cellular repair processes.

Deficiency of C1s (as well as C1r) often causes systemic lupus erythematosus-like syndromes and severe pyogenic infections. Selective and complete C1s deficiency accounts for early onset of multiple autoimmune diseases.

Additional references which are fully incorporated herein: Thielens et al. 1999. Immunopharmacology 42: 3-13; Gal et al. 2002. immunobiology 205: 383-394; Terai et al. 1997. Brain Res. 769: 385-390; Sullivan et al. 1996. J Rheumatol. 23: 2063-2067).

Complement Component C1s Splice Variants

The present inventors uncovered two novel splice variants of Complement component C1s (SEQ ID NOs:95, 96, 98, and 99; FIGS. 65a-d).

C1s Splice Variant T7 (HUMC1RS_T7) Structure

Figure 66:
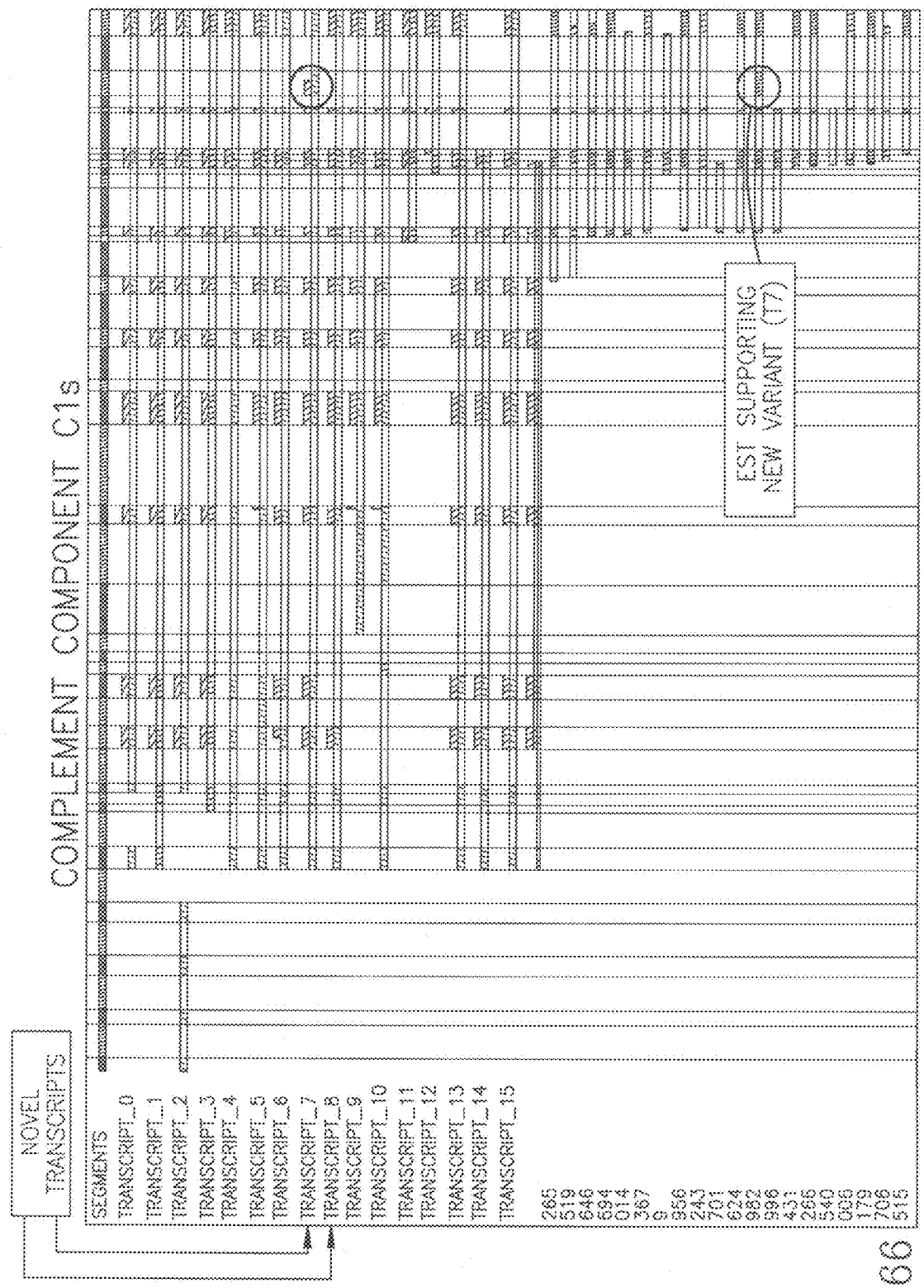
FIG. 66 is a schematic illustration depicting the graphical viewer scheme presenting the new variants of Complement component $C_1s$ (transcripts_T7 and T8) as compared to the wild type mRNA. The ESTs supporting the new variants are indicated. Transcript indicated as "0" represents known mRNA. The pattern code is as in FIG. 2.
Figure 68:
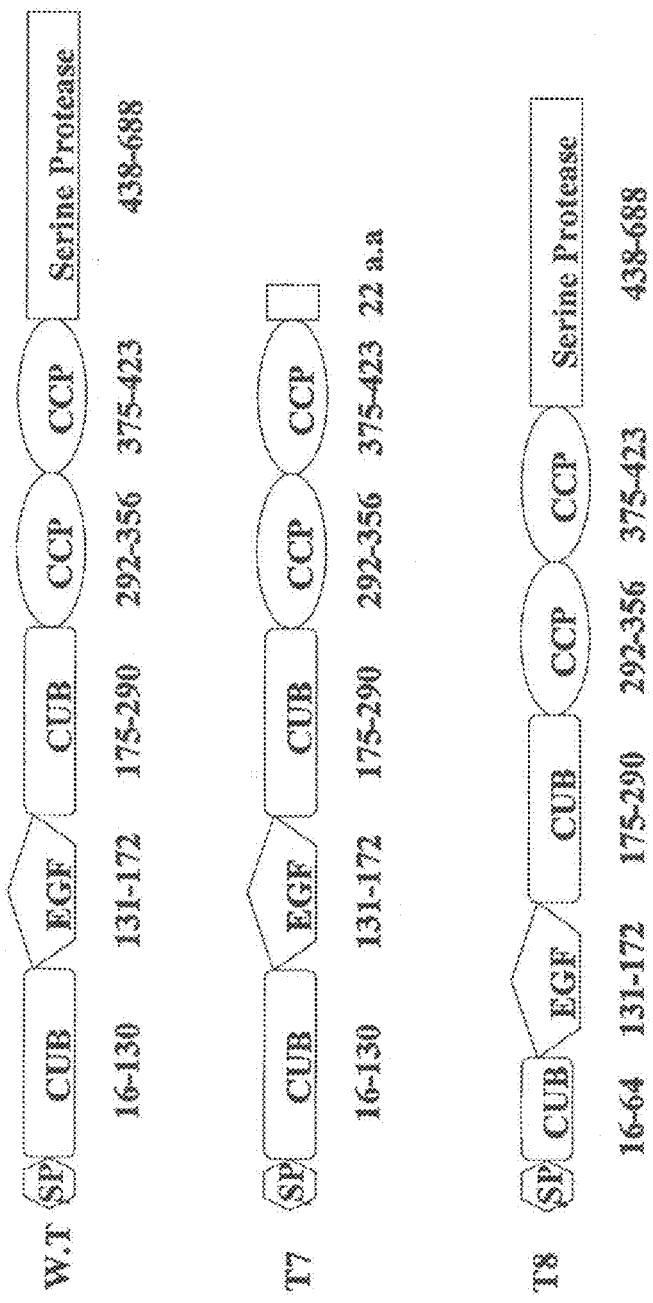
FIG. 68 is a schematic illustration showing the protein domain structure of wild-type Complement component C1s (SwissProt locus: C1S_HUMAN; SEQ ID NO:146) and the variants of the present invention (SEQ ID NO: 95 and 98). Unique regions are indicated (SEQ ID NO: 97 and 100).

C1s splice variant T7 (HUMC1RS_T7—SEQ ID NO:99 and HUMC1RS_P5-SEQ ID NO:98), FIG. 65a and b, respectively) result from alternative splicing of the C1s gene, thus introducing a new exon (exon 11a), causing the insertion of a stop codon, that result in a truncated C1s protein (FIGS. 66, 67a, 68). The variant protein thus created is a 455 amino acids long truncated protein, which contains the N-terminal 423 amino acids of wild type C1s (SEQ ID NO:146), followed by a unique sequence of 32 amino acids (SEQ ID NO:97). It contains the two CUB modules separated by an EGF module, and followed by two CCP modules, but it lacks the whole serine protease domain.

Comparison Report Between HUMC1RS_P5 and C1S_HUMAN

1. An isolated chimeric polypeptide HUMC1RS_P5, comprising a first amino acid sequence being at least 90% homologous to MWCIVLFSLLAWVYAEPTMYGEILSP-NYPQAYPSEVEKSWDIEVPEGYGIHL YFTHLDI-ELSENCAYDSVQIISGDTEEGRL-CGQRSSNNPHSPIVEEFQVPYNKL QVIFKSDFSNEERFTGFAAYYVATDI-NECTDFVDVPCSHFCNNFIGGYFCSCPP EYFLHD-DMKNCGVNCSGDVFTALIGEIASPNYPK-PYPENSRCEYQIRLEKGFQ VVVTLRREDFDVEAADSAGNCLD-SLVFVAGDRQFGPYCGHGFPGPLNIETKS NALDI-IFQTDLTGQKKGWKLRYHGDPMPCP-KEDTPNSVWEPAKAKYVFRDV VQITCLDGFEVVEGRVGATSFYSTCQS-NGKWSNSKLKCQPVDCGIPESIENGK VEDPES-TLFGSVIRYTCEEPYYYMENGGGGEYH-CAGNGSWVNEVLGPELPKC VP corresponding to amino acids 1-423 of C1S_HUMAN (SEQ ID NO:146), which also corresponds to amino acids 1-423 of HUMC1RS_P5 (SEQ ID NO:98), and a second amino acid sequence being at least 70%, optionally at least 80%, preferably at least 85%, more preferably at least 90% and most preferably at least 95% homologous to a polypeptide having the sequence GLNSDLPESSSVRWQYHCAVGCQGRGEPPQPH (SEQ ID NO:97) corresponding to amino acids 424-455 of HUMC1RS_P5, wherein said first amino acid sequence and second amino acid sequence are contiguous and in a sequential order.

2. An isolated polypeptide for a tail of HUMC1RS_P5, comprising a polypeptide being at least 70%, optionally at least about 80%, preferably at least about 85%, more preferably at least about 90% and most preferably at least about 95% homologous to the sequence GLNSDLPESSSVRWQYHCAVGCQGRGEPPQPH (SEQ ID NO:97) in HUMC1RS_P5.

C1s Splice Variant T8 (HUMC1RS_T8) Structure

C1s splice variant T8 (HUMC1RS_T8—SEQ ID NO:96 and HUMC1RS_P6-SEQ ID NO:95, FIG. 65c and d, respectively) result from alternative splicing of the C1s gene, thus leading to the skipping of exon 4 and the generation of a protein lacking amino acids 65-131 of wild type C1s, while introducing one novel amino acid Y in the junction (FIGS. 66, 67b, 68, SEQ ID NO:100). This splice variant encodes a 622 amino acids long protein which contains an incomplete first CUB domain followed by intact EGF, CUB, and two CCP modules, and possess a serine protease domain.

Comparison Report Between HUMC1RS_P6 and C1S_HUMAN

1. An isolated chimeric polypeptide HUMC1RS_P6, comprising a first amino acid sequence being at least 90% homologous to MWCIVLFSLLAWVYAEPTMYGEILSP-NYPQAYPSEVEKSWDIEVPEGYGIHL YFTHLDI-ELSEN corresponding to amino acids 1-64 of C1S_HUMAN (SEQ ID NO:146), which also corresponds to amino acids 1-64 of HUMC1RS_P6 (SEQ ID NO:95), a second amino acid sequence bridging amino acid sequence comprising of Y, and a third amino acid sequence being at least 90% homologous to INECTDFVDVPCSHFCNNFIGGYFC-SCPPEYFLHDDMKNCGVNCSGDVFTALI GEIASP-NYPKPYPENSRCEYQIRLEKGFQVVVTLRREDFDVE-AADSAGNCLDS LVFVAGDRQFGPYCGHGFPGPLNI-ETKSNALDIIFQTDLTGQKKGWKLRYHG DPMPCP-KEDTPNSVWEPAKAKYVFRDVVQIT-CLDGFEVVEGRVGATSFYSTC QSNGKWSNSKLKCQPVDC-GIPESIENGKVEDPESTLFGSVIRYTCEEPYYYME NGGGGEYHCAGNGSWVNEVLGPELP-KCVPVCGVPREPFEEKQRIIGGSDADI KNFP-WQVFEDNPWAGGALINEYWVLTAAH-VVEGNREPTMYVGSTSVQTSRL AKSKMLTPEHVFIHPGWKLLEVPEGRTN-FDNDIALVRLKDPVKMGPTVSPICL PGTSSDYN-LMDGDLGLISGWGRTEKRDRAVRLKAAR-LPVAPLRKCKEVKVE KPTADAEAYVFTPNMICAGGEKGMDSCK-GDSGGAFAVQDPNDKTKFYAAG LVSWGPQCGTYG-LYTRVKNYVDWIMKTMQENSTPRED corresponding to amino acids 132-688 of C1S_HUMAN (SEQ ID NO:146), which also corresponds to amino acids 66-622 of HUMC1RS_P6 (SEQ ID NO:95), wherein said first amino acid sequence, second amino acid sequence and third amino acid sequence are contiguous and in a sequential order.

2. An isolated polypeptide for an edge portion of HUMC1RS_P6 (SEQ ID NO:95), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NYI having a structure as follows (numbering according to HUMC1RS_P6; SEQ ID NO:95): a sequence starting from any of amino acid numbers 64-x to 64; and ending at any of amino acid numbers 66+((n−2)−x), in which x varies from 0 to n−2.

Therapeutic Applications for the C1s Splice Variants of the Present Invention

Using native and recombinant fragments of C1s it has been shown that the CUB-EGF region of C1s contains all the structural elements necessary for C1s to bind to C1r and C1q (Gal et al., 2002). Assembly of such a pseudo-C1 complexes retains their ability of C1r activation, despite the absent catalytic domain of C1s. Thus, the T7 variant that possess intact structure of first five modules but lacks the serine protease domain could serve as an antagonist for C1 activity, it might serve as a therapeutic agent in cases of unwanted or uncontrolled C1 activation such as inflammation resulting from ischemia and reperfusion, Alzheimer disease, rheumatoid arthritis, angioedema, and injury related tissue repair.

Structure-Function studies have shown that the CCP modules are responsible for the binding and proteolysis of C4 and C2 by C1s, while the CUB1-EGF modules are essential for the interaction of C1s with C1r (Gal et al., 2002). Since splice variant T8 has an incomplete first CUB domain, its ability to bind C1r will be harmed and therefore, it will not be active, however, it will still retain its ability to bind C1s substrates, namely C4 and C2. Thus, splice variant T8 will have antagonistic activity and might serve as a therapeutic agent in cases of unwanted or uncontrolled C1 activation as detailed above.

It will be appreciated that such an agent can be administered or provided to an individual in need thereof per se or as part of a pharmaceutical composition with a pharmaceutical acceptable carrier (e.g., PEG and liposomes).

Example 27

Splice Variant of Interleukin-1 Beta Precursor

Background

Interleukin-1 beta precursor (IL-1 beta; GenBank Accession No. P01584; IL1B_HUMAN) is a cytokine having an interleukin-1 β receptor binding activity and is involved in inflammatory and immune responses. IL-1β is produced by activated macrophages and is involved in thymocyte proliferation, B-cell maturation and proliferation, and fibroblast growth factor activity. IL-1 stimulate the release of prostaglandin and collagenase from synovial cells, can increase the expression of adhesion molecules and induce the production of paracrine IL-6. IL-1β has been implicated in human myeloma (Lust J A and Donovan K A, 1999; Hematol. Oncol. Clin. North. Am. 13: 1117-25). The fact that the IL-1β precursor lacks any specific hydrophobic segments suggests that IL-1 is released by damaged cells or is secreted in a unique mechanism.

IL-1β is overexpressed in immune T-cells and can be used as a marker for proliferation of these cells or as a marker for pathological de-differentiation of such cells.

Clinical Applications

IL-1β has been implicated in various diseases, disorders or conditions such as allergy, amyotrophic lateral sclerosis, rheumatoid arthritis, asthma, infection, inflammation (e.g., inflammatory bowel disease, sepsis, ocular inflammation), bone marrow transplant rejection, Alzheimer's disease, aplastic anaemia, osteo arthritis, cancer (e.g., breast, colorectal, melanoma, myeloma, prostate cancer, sarcoma), chemotherapy-induced injury, colitis, ulcerative, diabetes, fever, glaucoma, head trauma, ischaemia, cerebral myelodysplastic syndrome, nephritis, neuropathy, diabetic ocular disorder, pain, Parkinson's disease, Surgery adjunct, Ulcer decubitus.

Splice Variant HSPROI1B_T4 (SEQ ID NO: 269) Encodes a New Secreted Form of the IL-1, a HSPROI1B_X1 (SEQ ID NO: 270)

The present inventors have uncovered a new IL-1β variant [HSPROI1B_T4—SEQ ID NO: 269; HSPROI1B_X1—SEQ ID NO:2701. The protein coordinates on the transcript start from nucleotide 156 and end at nucleotide 878 as set forth in SEQ ID NO:269 (HSPROI1B_T4 transcript).

Alignment of the new IL-1β variant (HSPROI1B_X1—SEQ ID NO:270) with the WT protein (GenBank Accession No. P01584; SEQ ID NO:265) revealed that the new variant includes the first 199 amino acids as of the WT protein (GenBank Accession No. P01584) followed by a unique 42 amino acid sequence [VSECYGMKPFSASCYHLFPDNHLLPAPIPRKSWEQVYLTILH (SEQ ID NO:266), FIG. 117]. The new variant uncovered by the present invention exhibits 7 out of the 14 β-strand regions and 3 out of 7 hydrogen bond turns of the WT protein. The following interpro domains are missing or reduced in the new variant: IPR000975 Interleukin-1, IPR002348 Interleukin 1/heparin-binding growth factor, IPR003294 Interleukin-1, alpha/beta, IPR003296 Interleukin-1, beta IL1B. The new IL-10 variant of the present invention is expected to be an extracellular interleukin 1 modulator.

Comparison Report Between HSPROI1B_X1 (SEQ ID NO:270) and IL1B_HUMAN_V1 (SEQ ID NO:656)

1. An isolated chimeric polypeptide HSPROI1B_X1 (SEQ ID NO:270), comprising a first amino acid sequence being at least 90% homologous to MAEVPELASEMMAYYS-GNEDDLFFEADGPKQMKCSFQDLDLCPLDGGIQLRI SDHHYSKGFRQAASVVVAMDKLRKM-LVPCPQTFQENDLSTEEPFIFEEEPIFF DTWD-NEAYVHDAPVRSLNCTLRDSQQKSLVMS-GPYELKALHLQGQDMEQQ VVFSMSFVQGEESNDKIPVALGLKEKN-LYLSCVLKDDKPTLQLE corresponding to amino acids 1-199 of IL1B_HUMAN_V1 (SEQ ID NO:656), which also corresponds to amino acids 1-199 of HSPROI1B_X1 (SEQ ID NO:270), and a second amino acid sequence being at least 70%, optionally at least 80%, preferably at least 85%, more preferably at least 90% and most preferably at least 95% homologous to a polypeptide having the sequence VSECYG-MKPFSASCYHLFPDNHLLPAPIPRKSWEQVYLTILH (SEQ ID NO:266) corresponding to amino acids 200-241 of HSPROI1B_X1 (SEQ ID NO:270), wherein said first amino acid sequence and second amino acid sequence are contiguous and in a sequential order.

2. An isolated polypeptide for a tail of HSPROI1B_X1 (SEQ ID NO:270), comprising a polypeptide being at least 70%, optionally at least about 80%, preferably at least about 85%, more preferably at least about 90% and most preferably at least about 95% homologous to the sequence VSECYG-MKPFSASCYHLFPDNHLLPAPIPRKSWEQVYLTILH (SEQ ID NO:266) in HSPROI1B_X1 (SEQ ID NO:270).

Comparison Report Between HSPROI1B_X1 (SEQ ID NO:270) and IL1B_HUMAN (SEQ ID NO:265)

1. An isolated chimeric polypeptide HSPROI1B_X1 (SEQ ID NO:270), comprising a first amino acid sequence being at least 90% homologous to MAEVP corresponding to amino acids 1-5 of IL1B_HUMAN (SEQ ID NO:265), which also corresponds to amino acids 1-5 of HSPROI1B_X1 (SEQ ID NO:270), a bridging amino acid E corresponding to amino acid 6 of HSPROI1B_X1 (SEQ ID NO:270), a second amino acid sequence being at least 90% homologous to LASEM-MAYYSGNEDDLFFEADGPKQMKCS-FQDLDLCPLDGGIQLRISDHHYS KGERQAASV-VVAMDKLRKMLVPCPQTFQENDLSTEEPFIFEEEPIFF-DTWDNE AYVHDAPVRSLNCTLRDSQQKSLVMSG-PYELKALHLQGQDMEQQVVFSMSF VQGEESND-KIPVALGLKEKNLYLSCVLKDDKPTLQLE corresponding to amino acids 7-199 of IL1B_HUMAN (SEQ ID NO:265), which also corresponds to amino acids 7-199 of HSPROI1B_X1 (SEQ ID NO:270), and a third amino acid sequence being at least 70%, optionally at least 80%, preferably at least 85%, more preferably at least 90% and most preferably at least 95% homologous to a polypeptide having the sequence VSECYGMKPFSASCYHLFPDNHLLPA-PIPRKSWEQVYLTILH (SEQ ID NO:266) corresponding to amino acids 200-241 of HSPROI1B_X1 (SEQ ID NO:270), wherein said first amino acid sequence, bridging amino acid, second amino acid sequence and third amino acid sequence are contiguous and in a sequential order.

2. An isolated polypeptide for a tail of HSPROI1B_X1 (SEQ ID NO:270), comprising a polypeptide being at least 70%, optionally at least about 80%, preferably at least about 85%, more preferably at least about 90% and most preferably at least about 95% homologous to the sequence VSECYG- MKPFSASCYHLFPDNHLLPAPIPRKSWEQVYLTILH (SEQ ID NO:266) in HSPROI1B_X1 (SEQ ID NO:270).

Since the HSPROI1B_X1 variant of the present invention is a truncated form of IL-1β it can compete with the endogenous IL-1β and interfere with its various activities.

Thus, the present inventors have uncovered a therapeutic agent, a polypeptide homologous to SEQ ID NO:270 and/or an expressible polynucleotide homologous to SEQ ID NO:269 and/or a peptide homologous to SEQ ID NO:266 which can be used as an anti-inflammatory (e.g., for GI inflammatory, bowel disorders), antiallergic, antiarthritic, antiasthma, anticancer, immunosuppressant, septic shock treatment, analgesic, NSAID, antianaemic, antibiotic, antidiabetic, antiglaucoma, antiparkinsonian, antipsoriasis, antiulcer, antiviral, anti-HIV (anti AIDS), cardiovascular, cognition enhancer, dermatological, haematological, hepatoprotective, hypolipaemic, antiatherosclerosis, immunomodulator, anti-infective, immunostimulant, multiple sclerosis treatment, neurological, neuroprotective, ophthalmological, osteoporosis treatment, radio/chemoprotective, radio/chemosensitizer, respiratory, stomatological, symptomatic antidiabetic, urological, and vulnerary agent.

It will be appreciated that such an agent can be administered or provided to an individual in need thereof per se or as part of a pharmaceutical composition with a pharmaceutical acceptable carrier (e.g., PEG and liposomes).

While further reducing the present invention to practice, these results suggest the use of the new IL-1β variant of the present invention (HSPROI1B_X1—SEQ ID NO:270), the polynucleotide encoding same (HSPROI1B_T4—SEQ ID NO:269) and/or the peptide derived from the HSPROI1B_X1 variant (SEQ ID NO:266) as a diagnostic marker for immune T-cells proliferation or de-differentiation, as well as various cancers. Diagnosis according to this aspect of the present invention is effected using immunological assays [e.g., Western Blot, immunohistochemistry, FACS analysis, radio immuno assay (RIA), immunofluorescence, and the like using an antibody directed against the IL-1βvariant (HSPROI1B_X1—SEQ ID NO:270)], nucleic acid techniques (NAT) such as RT-PCR, Northern Blot, in situ hybridization, in situ RT-PCR.

Example 28

Splice Variant of Integrin Alpha-IIb Precursor

Background

Integrin αIIβ (also designated glycoprotein IIb) is a platelet adhesion receptor that forms a heterodimeric receptor with β3 (GPIIIa) subunit. Both subunits must be cosynthesized to be expressed on the cell surface. αIIβ expression is limited to platelets, megakaryocytes, and some transformed cells, and its naturally occurring ligands are fibrinogen, von Willebrand factor, fibronectin and vitronectin (all of which contain RGD sequence). On unstimulated platelets, it exists in a resting conformation, unable to bind large extracellular adhesive ligands and it becomes activated upon platelet stimulation via "inside-out" (cytoplasmic) signaling, or by binding small ligands (such as the RGD peptide). This allows ligand binding that leads to further conformational change and to "outside-in" signaling. Activated αIIβ 3 mediates fibrinogen binding and platelet aggregation. These activities prevent blood loss at sites of vascular injury, however, on ruptured atherosclerotic plaques it contribute directly to myocardial infraction and stroke (Naik and Parise, 1997).

The αIIβ and the β3 subunits are synthesized as single chains and assembled intracellularly into heterodimers, in a $Ca^{2+}$-dependent process. The αIIβ subunit undergoes proteolytic cleavage, generating a mature disulfide-linked heavy and light chains. The light chain contains the cytoplasmic and the transmembrane domains whereas most of the extracellular domain is obtained by the heavy chain, which forms a large disulfide-linked loop and contains seven FG-GAP domains and four cation binding sites. The ligand specificity of αIIβ is attributed to the first third of the N-terminal portion of the extracellular domain, which includes the first two $Ca^{2+}$-binding sites (Naik and Parise, 1997).

Clinical Applications

Platelets play an important role in the pathophysiology of acute myocardial infraction, unstable angina, and ischemic stroke. αIIβ3 constitutes the common pathway for platelet aggregation. A number of αIIβ3 antagonists were developed and evaluated in clinical trials. Three of them are approved in the US and other countries: abciximab (antibody Fab fragment), eptifibatide (a cyclic heptapeptide) and tirofiban (a tyrosin-derived non-peptide molecule). The greatest clinical impact of these agents (used in conjunction with heparin and aspirin) has been in the prevention of ischemic complications after percutaneous coronary intervention. Eptifibatide and tirofiban are specific for αIIβ3, whereas abciximab also exhibit cross-reactivity with αvβ3 and αMβ2. Abciximab has been more efficacious than the other agents, probably due to its cross reactivity with the other integrins. Abciximab has also yielded promising results in experimental models of tumor angiogenesis and sickle cell anemia (Leclerc et al., 2002). In addition, it has been described (in the pharma) as a launched drug for unstable angina, restenosis, coronary thrombosis, and surgery adjunct, and in phase III of clinical trials for treatment of Crohn's disease myocardial infraction, and cerebral ischemia.

Another pathogenenesis involving αIIβ3 is chronic immune thrombocytopenia purpura (AITP). Patients with AITP produce autoantibodies, directed mainly against αIIβ3, that cause platelet destruction. Two recombinant anti-idiotypic antibodies have been described to block the interaction of the autoantibodies with αIIβ3 in AITP patients (Escher et al., 2002).

Integrin αIIβ Splice Variants

The present inventors uncovered two novel splice variants of integrin αIIβ3 gene (SEQ ID NOs: 83, 84, 86 and 87; FIGS. 53a-b, 54a-b).

The T8 Splice Variant (HUMGPIIBA_R36—SEQ ID NO:87)

Figure 56:
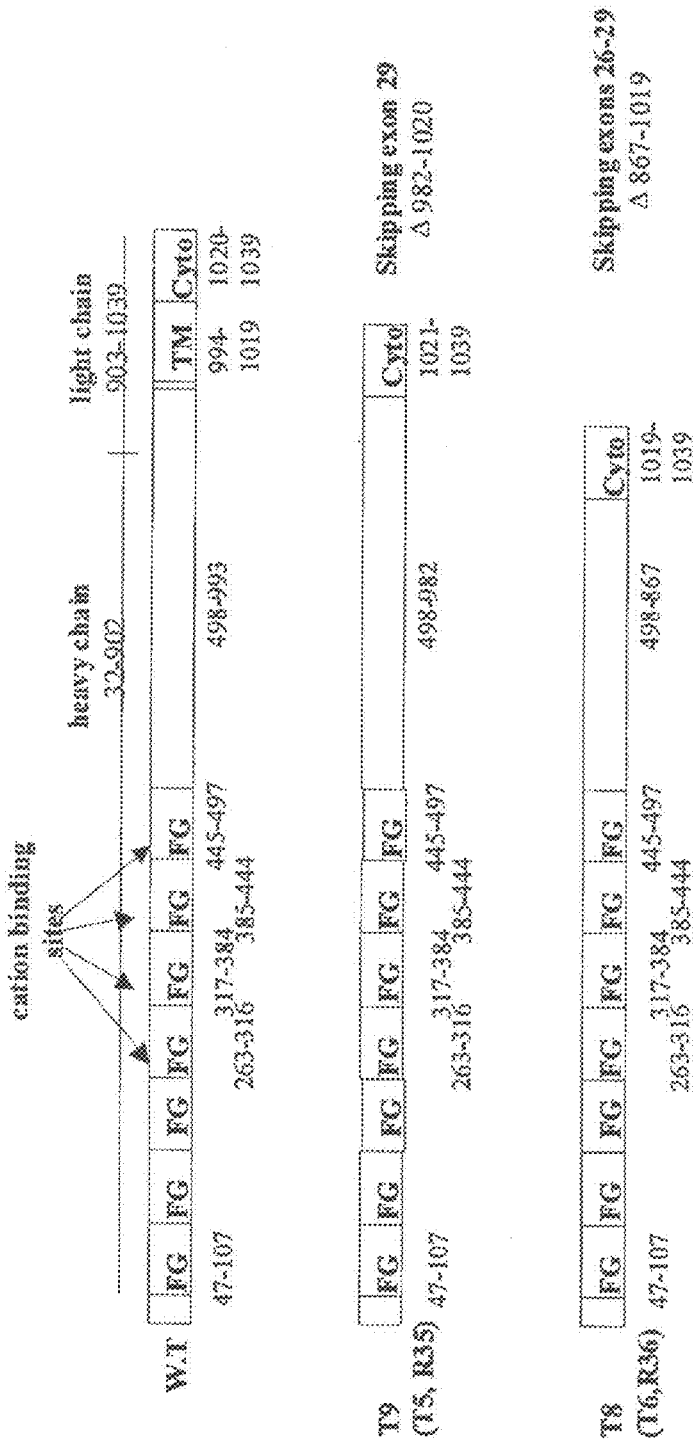
FIG. 56 is a schematic illustration showing the protein domain structure of wild-type Integrin alpha-IIb (SwissProt locus: ITAB_HUMAN; SEQ ID NO:143) and the variants of the present invention (SEQ ID NOs:83 and 86).

The T8 splice variant (HUMGPIIBA_R36—SEQ ID NO:87; FIG. 54a) was obtained by the alternative splicing of the integrin αIIβ gene, thus leading to skipping of exons 26, 27, 28, 29 and the generation of a new αIIβ variant (HUMGPIIBA_X26—SEQ ID NO:86; FIG. 54b). Alignment of the new αIIβ variant (variant T8; SEQ ID NO:83) with the WT protein (ITAB_HUMAN; SEQ ID NO:143) revealed that the new variant lacks amino acids 867-1019 of wild type αIIβ (FIG. 55b, 56). This splice variant encodes 886 amino acids long protein (SEQ ID NO:86). It encompasses most of the heavy chain, including FG-GAPS I-VH within it, and the cytoplasmic domain, while it lacks the extracellular portion of the light chain and the TM. It contains four out of seven potential N-glycosilation sites and seven out of nine disulfide bonds.

Comparison Report Between HUMGPIIBA_X26 (SEQ ID NO:86) and ITAB_HUMAN (SEQ ID NO:143)

1. An isolated chimeric polypeptide HUMGPIIBA_X26 (SEQ ID NO:86), comprising a first amino acid sequence being at least 90% homologous to MARALCPLQAL-WLLEWVLLLLGPCAAPPAWALNLD- PVQLTFYAGPNGSQFG FSLDFHKDSHGRVAIV-VGAPRTLGPSQEETGGVFLCPWRAEGGQCPSLLFDLR DETRNVGSQTLQTFKARQGLGASVVSWS-DVIVACAPWQHWNVLEKTEEAEK TPVGSC-FLAQPESGRRAEYSPCRGNTLSRIYV-ENDFSWDKRYCEAGFSSVVTQ AGELVLGAPGGYYFLGLLAQAPVADIF-SSYRPGILLWHVSSQSLSFDSSNPEYF DGYWGYS-VAVGEFDGDLNTTEYVVGAPTWSWTL-GAVEILDSYYQRLHRLR AEQMASYFGHSVAVTDVNGDGRHDLLV-GAPLYMESRADRKLAEVGRVYLF LQPRGPHAL-GAPSLLLTGTQLYGRFGSAIA-PLGDLDRDGYNDIAVAAPYGGPS GRGQVLVFLGQSEGLRSRPSQVLDSPF-PTGSAFGFSLRGAVDIDDNGYPDLIV GAYGAN-QVAVYRAQPVVKASVQLLVQDSLNPAVK-SCVLPQTKTPVSCFNIQ MCVGATGHNIPQKLSLNAELQLDRQK-PRQGRRVLLLGSQQAGTTLNLDLGG KHSPICHTT-MAFLRDEADERDKLSPIVLSLNVSLPP-TEAGMAPAVVLHGDTHV QEQTRIVLDCGEDDVCVPQLQLTASVTG-SPLLVGADNVLELQMDAANEGEG AYEAELAVHLPQ-GAHYMRALSNVEGFERLICNQKKEN-ETRVVLCELGNPMK KNAQIGIAMLVSVGNLEEAGESVSFQL-QIRSKNSQNPNSKIVLLDVPVRAEAQ VELRGNSF-PASLVVAAEEGEREQNSLDSWGPKVE-HTYELHNNGPGTVNGLH LSIHLPGQSQPSDLLYILDIQPQGGLQCFPQPPVNPL corresponding to amino acids 1-866 of ITAB_HUMAN (SEQ ID NO:143), which also corresponds to amino acids 1-866 of HUMGPIIBA_X26 (SEQ ID NO:86), and a second amino acid sequence being at least 90% homologous to KVG-FFKRNRPPLEEDDEEGE corresponding to amino acids 1020-1039 of ITAB_HUMAN (SEQ ID NO:143), which also corresponds to amino acids 867-886 of HUMGPIIBA_X26 (SEQ ID NO:86), wherein said first amino acid sequence and second amino acid sequence are contiguous and in a sequential order.

2. An isolated chimeric polypeptide for an edge portion of HUMGPIIBA_X26 (SEQ ID NO:86), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LK, having a structure as follows: a sequence starting from any of amino acid numbers 866-x to 866; and ending at any of amino acid numbers 867+((n−2)−x), in which x varies from 0 to n−2.

The T9 Splice Variant (HUMGPIIBA_R35—SEQ ID NO:84)

The T9 splice variant (HUMGPIIBA_R35— SEQ ID NO:84; FIG. 53a) was obtained by the alternative splicing of the integrin αIIβ gene, thus leading to skipping of exon 29 and the generation of a of a new αIIβ variant (HUMGPIIBA_X24—SEQ ID NO:83; FIG. 53b). Alignment of the new αIIβ variant protein (variant T9, HUMGPIIBA_X24) with the WT protein (ITAB_HUMAN; SEQ ID NO:143) revealed that the new variant lacks lacking amino acids 982-1020 of wild type αIIβ (FIGS. 55a, 56). This splice variant encodes 1000 amino acids long protein (SEQ ID NO:83). It encompasses the heavy chain including FG-GAPS I-VII within it, part of the extracellular portion of the light chain, and the cytoplasmic domain, while it lacks the TM. It contains all the potential N-glycosilation sites and disulfide bonds.

Comparison Report Between HUMGPIIBA_X24 (SEQ ID NO:83) and ITAB_HUMAN (SEQ ID NO:143)

1. An isolated chimeric polypeptide HUMGPIIBA_X24 (SEQ ID NO:83), comprising a first amino acid sequence being at least 90% homologous to MARALCPLQAL-WLLEWVLLLLGPCAAPPAWALNLD-PVQLTFYAGPNGSQFG FSLDFHKDSHGRVAIV-VGAPRTLGPSQEETGGVFLCPWRAEGGQCPSLLFDLR DETRNVGSQTLQTFKARQGLGASVVSWS-DVIVACAPWQHWNVLEKTEEAEK TPVGSC-FLAQPESGRRAEYSPCRGNTLSRIYV-ENDFSWDKRYCEAGFSSVVTQ AGELVLGAPGGYYFLGLLAQAPVADIF-SSYRPGILLWHVSSQSLSEDSSNPEYF DGYWGYS-VAVGEFDGDLNTTEYVVGAPTWSWTL-GAVEILDSYYQRLHRLR AEQMASYFGHSVAVTDVNGDGRHDLLV-GAPLYMESRADRKLAEVGRVYLF LQPRGPHAL-GAPSLLLTGTQLYGRFGSAIA-PLGDLDRDGYNDIAVAAPYGGPS GRGQVLVFLGQSEGLRSRPSQVLDSPF-PTGSAFGFSLRGAVDIDDNGYPDLIV GAYGAN-QVAVYRAQPVVKASVQLLVQDSLNPAVK-SCVLPQTKTPVSCFNIQ MCVGATGHNIPQKLSLNAELQLDRQK-PRQGRRVLLLGSQQAGTTLNLDLGG KHSPICHTT-MAFLRDEADPRDKLSPIVLSLNVSLPP-TEAGMAPAVVLHGDTHV QEQTRIVLDCGEDDVCVPQLQLTASVTG-SPLLVGADNVLELQMDAANEGEG AYEAELAVHLPQ-GAHYMRALSNVEGFERLICNQKKEN-ETRVVLCELGNPMK KNAQIGIAMLVSVGNLEEAGESVSFQL-QIRSKNSQNPNSKIVLLDVPVRAEAQ VELRGNSF-PASLVVAAEEGEREQNSLDSWGPKVE-HTYELHNNGPGTVNGLH LSIHLPGQSQPSDLLYILDIQPQG-GLQCFPQPPVNPLKVDWGLPIPSPSPIHPAH HKRDRR-QIFLPEPEQPSRLQDPVLVSCDSAPCTV-VQCDLQEMARGQRAMVTV LAFLWLPSLYQRPLDQFVLQSHAWFN-VSSLPYAVPPLSLPRGEAQ corresponding to amino acids 1-981 of ITAB_HUMAN (SEQ ID NO:143), which also corresponds to amino acids 1-981 of HUMGPIIBA_X24 (SEQ ID NO:83), and a second amino acid sequence being at least 90% homologous to VGFFKRNRPPLEEDDEEGE corresponding to amino acids 1021-1039 of ITAB_HUMAN (SEQ ID NO:143), which also corresponds to amino acids 982-1000 of HUMGPIIBA_X24 (SEQ ID NO:83), wherein said first amino acid sequence and second amino acid sequence are contiguous and in a sequential order.

2. An isolated chimeric polypeptide for an edge portion of HUMGPIIBA_X24 (SEQ ID NO:83), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QV, having a structure as follows: a sequence starting from any of amino acid numbers 981-x to 981; and ending at any of amino acid numbers 982+((n−2)−x), in which x varies from 0 to n−2.

Therapeutic Application of the Variants

Peterson et al. have generated a soluble recombinant form of integrin αIIβ3 (rsαIIbβ3) lacking the transmembrane and the cytoplasmic domains. The high yield of soluble integrin produced in this study is attributed to the inclusion of the entire extracellular region of αIIβ light chain in the construct. rsαIIbβ3 was shown to react spontaneously with fibrinogen, and this interaction was inhibited in the presence of RGD peptides. rsαIIbβ3 reacted with a variety of antibodies specific to platelet αIIbβ3, it is predicted to maintain the ligand binding conformation.

Based on these evidences, T9, which is predicted to be a soluble form of αIIβ can be used for production of a soluble αIIbβ3 when co-expressed with a soluble form of the β3 subunit. Such a heterodimer might antagonize platelet αIIbβ3 interaction with its natural ligands (Peterson at al., 1998; Wang et al., 1997, Esher et al., 1995).

T8 encompass a shorter extracellular region than T9, which completely lacks the light chain. Thus, it might form a heterodimer with β3 and serve as an antagonist for αIIbβ3 interaction with its natural ligands, however, such a construct might be secreted in low amounts.

Thus, the present inventors have uncovered a therapeutic agent, a polypeptide homologous to SEQ ID NO:86 or 83 and/or an expressible polynucleotide homologous to SEQ ID NO:87 or 84 which can be used as an antagonist of the platelet αIIbβ3 interaction with its natural ligands and thus prevent and/or treat ischemic complications after percutaneous coronary intervention, unstable angina, restenosis, coronary thrombosis, surgery adjunct, Crohn's disease, myocardial infraction, and cerebral ischemia. In addition, such a therapeutic agent can be used as a target for autoantibodies directed against αIIβ3 [e.g., in the case of chronic immune thrombocytopenia purpura (AITP)] and thus prevent platelet destruction.

It will be appreciated that such an agent can be administered or provided to an individual in need thereof per se or as part of a pharmaceutical composition with a pharmaceutical acceptable carrier (e.g., PEG and liposomes).

Example 29

Splice Variant of Integrin Alpha-4 Precursor

Background

Integrins are cell surface receptors that mediate cell adhesion to extracellular matrix (ECM) as well as cell-cell adhesion. The integrin family is composed of 19 different α subunits and 8 different β subunits that are associated, in a non-covalent manner, to form 25 different heterodimers with many distinct ligand-binding properties (Humphries, 2000). Integrin α4 can form heterodimers with either α1 or β7. The α4β1 (VLA4) complex is expressed on B and T cells, thymocytes, monocytes, eosenophils, basophils, macrophages, and some melanoma cells, and has several distinct adhesion activities: (i) it binds fibronectin, (ii) it binds activated endothelium via VCAM-1 (vascular cell adhesion molecule-1) (iii) it involves in the intercellular leukocyte interaction (homotypic aggregation), and (iv) may play a role in cytolytic T cell function (Teixido et al., 1992). As a result of its binding activity, VLA4 plays a role in leukocyte recruitment to inflammatory sites. In addition, adhesion of VLA4 bearing tumor cells to VCAM-1 indicates a role for VLA4 during metastasis. As opposed to α4β1, the α4β7 heterodimer is expressed mainly on lymphocytes that home to the intestine and to associated lymphoid tissues such as Peyer's patches. It binds mainly MAdCAM-1 which is expressed on the high endothelial venules (HEV) of Peyer's patches, on mesenteric lymph node HEV and on lamina propria venules within the gut, but it also binds VCAM-1. Both VCAM-1 and MAdCAM-1 are expressed upon inflammation in the gut, however, VCAM-1 is also expressed in peripheral organs while MAdCAM-1 expression is confined to the gut. Thus, MAdCAM-1 is thought to be involved in the recruitment of leukocytes to the gut in chronic inflammatory diseases. The α4β1 and α4β7 integrins have been shown the mediate the initial rolling of immune cells but furthermore, upon chemokine activation, they mediate firm adhesion to cytokine-activated endothelium.

Structurally, integrin α4 is composed of seven N-terminal repeats designated GF-GAPs followed by a sequence with no identified domains, a transmembrane domain and a cytoplasmic tail which is capable of transducing intracellular signals. Integrin α4 encompasses three cation binding sites (also designated EF-hands) within the last three GF-GAP domains. These sites are involved in ligand binding. The α4 subunit can be expressed on cell surface either as an intact form (α4-150) or can be cleaved near the middle of the molecule into non-disulfide-linked fragments of 80 and 70 KDa (Teixido et al., 1992). The cleavage of α4 is a regulated, compartmentalized event, occurring soon after maturation of the β1-associated α4 subunit, and it is supposed to have a role in integrin activation (α6 cleavage mutants are capable of binding matrix but defective in inside-out signaling upon PMA activation) (Blue et al., 1993).

Clinical Applications

Elevated MAdCAM-1 expression in the gastrointestinal tract has been linked with several gastrointestinal autoimmune diseases, including Crohn's disease, ulcerative colitis, and hepatitis C. Expression of VCAM-1 on HEVs in the lung is correlated with asthma and its expression in the synovium and in nervous tissues is thought to be linked to rheumatoid arthritis and multiple sclerosis, respectively. VCAM-1 expression is also associated with inflammatory bowel disease (Jackson, 2002). α4 integrins have also been implicated in the pathogenesis of cardiovascular diseases, most notably atherosclerosis and ischemia reperfusion injury (Liu et al., 2000). In vivo and in vitro studies have shown that blockage of α4β1 inhibits the attachment and recruitment of mononuclear leukocytes during atherosclerosis. In addition to their role in the inflammatory process, binding of α4 integrins to their ligands may also play important roles in stem cell adhesion to bone marrow stromal cells, and in tumor cell metastasis (Jackson, 2002). Furthermore, VLA4 is involved in graft rejection and its blockage by antibodies result in increased survival in mice model of hurt transplant. The pro-survival effect was increased upon combined treatment with antibodies for both VLA4 and VCAM-1 (Isobe et al., 1998). mAbs directed for α4 can also efficiently inhibit Insulin-dependent diabetes mellitus (Michie et al., 1998). As α4 integrins are widely implicated in disease processes, they are attractive targets for the development of antagonists. Such antagonists have been developed in the form of mAbs, peptides, peptidomimetics, proteomimetics, and small molecules, most of which are targeted to block α4β1, however, non-specific α4 inhibitors that will inhibit both α4β1 and α4β7 are thought to afford the greatest benefit for treatment of autoimmune diseases since a generic α4 integrin antagonist would be useful for a broader range of indications (Jackson, 2002).

Splice Variant Structure

Figure 79:
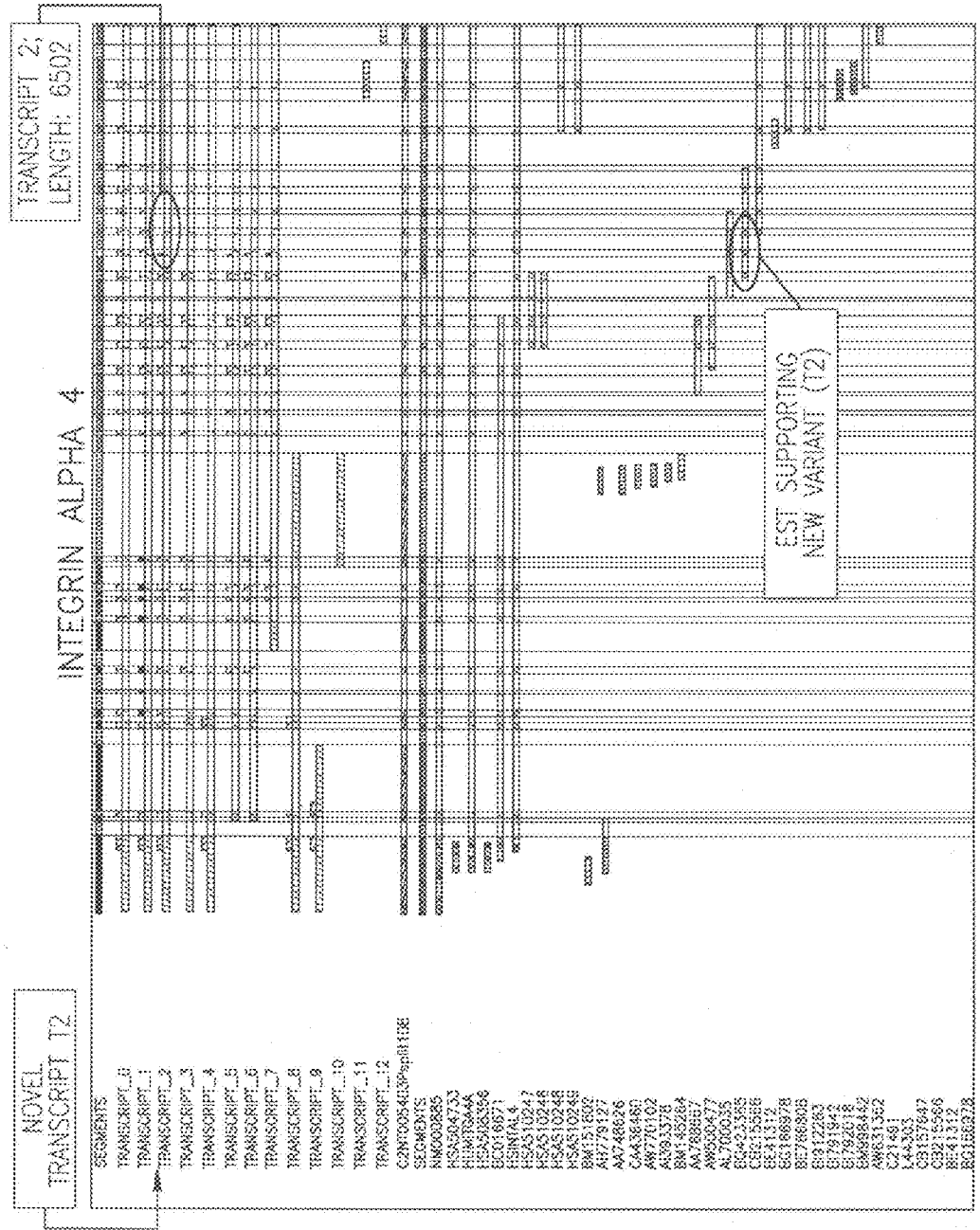
FIG. 79 is a schematic illustration depicting the graphical viewer scheme presenting the new variant of Integrin alpha 4 (transcript_2) as compared to the wild type mRNA. The ESTs supporting the new variant are indicated. Transcript indicated as "0" represents known mRNA. The pattern code is as in FIG. 2.

The present inventors uncovered a novel splice variant of Integrin α4 (HSINTAL4_T2—SEQ ID NO:111; FIG. 78a). Integrin α4 splice variant T2 result from alternative splicing of the integrin α4 gene, leading to extension of exon 19 due to splicing in an alternative 5' acceptor site of exon 19 (FIGS. 79-81). This leads to insertion of a stop codon and result in a truncated integrin α4 protein of 703 amino acids (HSINTAL4_P2—SEQ ID NO:110; FIG. 78b). The protein coordinates on the transcript start from nucleotide 1152 and end at nucleotide 3260 as set forth in SEQ ID NO:111 (HSINTAL4_T2 transcript).

Alignment of the new integrin α4 variant (HSINTAL4_P2—SEQ ID NO:110) with the WT protein (GenBank Accession No. P13612; SEQ ID NO:149) revealed that the new that includes 697 wild type amino acids and 6 unique amino acids (LFHFSH; SEQ ID NO:112). It contains the seven N-terminal repeats designated GF-GAPs, and a part of the following sequence with no identified domains; it lacks the transmembrane domain and the cytoplasmic tail. Within this region, it contains the three cation binding motifs (also designated EF-hands), the cleavage site, 6 out of 9 disulfide bonds and 9 out of 11 potential glycosylation sites residing within the extracellular domain.

Comparison Report Between HSINTAL4_P2 (SEQ ID NO:110) and ITA4_HUMAN (SEQ ID NO:149)

1. An isolated chimeric polypeptide HSINTAL4_P2 (SEQ ID NO:110), comprising a first amino acid sequence being at least 90% homologous to MFPTESAWLGKRGANP corresponding to amino acids 1-16 of ITA4_HUMAN (SEQ ID NO:149), which also corresponds to amino acids 1-16 of HSINTAL4_P2 (SEQ ID NO:110), a bridging amino acid A corresponding to amino acid 17 of HSINTAL4_P2 (SEQ ID NO:110), a second amino acid sequence being at least 90% homologous to PEAAVRETVMLLLCLGVPTGRPYN-VDTESALLYQGPHNTLFGYSVVLHSHGA NRWLLV-GAPTANWLANASVINPGAIYRCRIGKN-PGQTCEQLQLGSPNGEPCG KTCLEERDNQWLGVTLSRQPGENG-SIVTCGHRWKNIFYIKNENKLPTGGCYG VPPDLR-TELSKRIAPCYQDYVKKFGENFASCQAG-ISSFYTKDLIVMGAPGSSY WTGSLFVYNITTNKYKAFLDKQNQVKFG-SYLGYSVGAGHFRSQHTTEVVGG APQHEQIGKAYIF-SIDEKELNILHEMKGKKLGSYFGASV-CAVDLNADGFSDLL VGAPMQSTIREEGRVFVYINSGSGAVM-NAMETNLVGSDKYAARFGESIVNLG DIDNDGEED-VAIGAPQEDDLQGAIYIYNGRADGISS-TESQRIEGLQISKSLSMFG QSISGQIDADNNGYVDVAVGAFRSDSAV-LLRTRPVVIVDASLSHPESVNRTKF DCVENGWPSV-CIDLTLCFSYKGKEVPGYIVLFYNMSLD-VNRKAESPPRFYFSS NGTSDVITGSIQVSSREANCRTHQAFM-RKDVRDILTPIQIEAAYHLGPHVISKR STEEFP-PLQPILQQKKEKDIMKKTINFARFCA-HENCSADLQVSAKIGFLKPHEN KTYLAVGSMKTLMLNVSLFNAGDDAYET-TLHVKLPVGLYFIKILEL corresponding to amino acids 18-697 of ITA4_HUMAN (SEQ ID NO:149), which also corresponds to amino acids 18-697 of HSINTAL4_P2 (SEQ ID NO:110), and a third amino acid sequence being at least 70%, optionally at least 80%, preferably at least 85%, more preferably at least 90% and most preferably at least 95% homologous to a polypeptide having the sequence LFHFSH (SEQ ID NO:112) corresponding to amino acids 698-703 of HSINTAL4_P2 (SEQ ID NO:110), wherein said first amino acid sequence, bridging amino acid, second amino acid sequence and third amino acid sequence are contiguous and in a sequential order.

2. An isolated polypeptide for a tail of HSINTAL4_P2 (SEQ ID NO:110), comprising a polypeptide being at least 70%, optionally at least about 80%, preferably at least about 85%, more preferably at least about 90% and most preferably at least about 95% homologous to the sequence LFHFSH (SEQ ID NO:112) in HSINTAL4_P2 (SEQ ID NO:110).

Therapeutic Application of the Splice Variant

Recombinant soluble α4β1 have been previously produced by co-transfecting insect cells with both α and β chains lacking the transmembrane and cytoplasmic domains. These rsα4β1 were able to dimerize, to bind their ligands, and retained specific mAbs epitopes indicating the transmembrane domain and the cytoplasmic tail are not necessary for these activities (Humphries, 2000). Splice variant T2 contains an incomplete extracellular domain that contains many of the sites reported to be important for ligand binding, however, it does not contain Asp-698 and Asp-811 that are reported to be important for LDV binding (but not for RGD binding) (Zeller et al., 1997). Apparently, T2 might bind fibronectin and MAd-CAM-1, however it is not clear whether this binding activity could be attributed to α4 which is not dimerized with a β subunit. Moreover, the dimerization process is poorly described and it is not clear whether it is an intracellular process or a membranal process. Antagonists for α4β7 and for α4β1 have been described in phase II of clinical trials for treatment of Crohn's disease, ulcerative colitis, asthma, rheumatoid arthritis, multiple sclerosis and inflammatory bowel disease. α4β1 antagonist was also described for treatment of head trauma.

Thus, the present inventors have uncovered a therapeutic agent, a polypeptide homologous to SEQ ID NO:110 and/or an expressible polynucleotide homologous to SEQ ID NO:111 and/or a peptide homologous to SEQ ID NO:112 which can be serve as an antagonist of α4 interaction with either al, β7 or β4, and/or an antagonist for the α4β34 and/or α4β7 receptor. As such, the agent of the present invention can be used treat gastrointestinal autoimmune diseases (e.g., Crohn's disease, ulcerative colitis, and hepatitis C), asthma, rheumatoid arthritis, multiple sclerosis, inflammatory bowel disease, cardiovascular diseases (e.g., atherosclerosis and ischemia reperfusion injury), tumor cell metastasis, graft rejection, and insulin-dependent diabetes mellitus.

It will be appreciated that such an agent can be administered or provided to an individual in need thereof per se or as part of a pharmaceutical composition with a pharmaceutical acceptable carrier (e.g., PEG and liposomes).

Example 30

Splice Variant of Beta Platelet-Derived Growth Factor Receptor Precursor (PDGF-R-BETA)

Background

The beta platelet-derived growth factor receptor precursor (PDGF-R-β; CD140b antigen; GenBank Accession No. P09619; PGDR_HUMAN; PDGFRB) is a type I transmembrane protein, transmembrane receptor protein tyrosine kinase involves in signaling pathway and cell growth and/or maintenance.

PDGF-R-β has been implicated in decubitus ulcer, diabetic ulcer, various cancers (e.g., leukaemia), hyperlipidaemia, glomerulonephritis and renal failure, restenosis, infection, peripheral vascular disease, tissue regeneration (e.g., bone), thrombocytopenia, and wound healing.

PDGF-R-β is overexpressed in pancreatic tumors it can be used as a marker for these pathologies.

Splice Variant HUMPDGFR_T13 (SEQ ID NO:271) Encodes a New Secreted Form of the PDGF-R-β, HUMPDG-FR_P6 (SEQ ID NO:272)

The present inventors have uncovered a new PDGF-R-β variant [HUMPDGFR_T13—SEQ ID NO:271; HUMPDG- FR_P6—SEQ ID NO:272]. The protein coordinates on the transcript start from nucleotide 474 and end at nucleotide 2108 as set forth in SEQ ID NO:271 (HUMPDGFR_T13 transcript).

Alignment of the new PDGF-R-β variant (HUMPDG-FR_P6—SEQ ID NO:272) with the WT protein (GenBank Accession No. P09619; SEQ ID NO:267) revealed that the new variant includes the first 526 amino acids as of the WT protein (GenBank Accession No. P09619) followed by a unique 19 amino acid sequence [CESPASVAPDDPNPYL-NPA (SEQ ID NO:268), FIG. 118]. The new variant uncovered by the present invention lacks the transmembrane domain (amino acids 532-556 of WT), cytoplasmic domain (amino acids 557-1106 of WT), np binding domain (amino acids 606-614 of WT), two phosphotyrosine sites (amino acids 751 and 857 of WT), and the PDGFRB active site (amino acid 826 of WT). Thus, the new PDGF-R-β variant of the present invention lacks the Protein kinase (IPR000719) and Tyrosine protein kinase (IPR001245) domains, as well as the TM domain and thus is expected to be a secreted, extracellular protein. Such a protein can compete with the endogenous PDGF-R-β, interfere with its various activities, and serve as a PDGF-R-β antagonist or a platelet growth factor modulator.

Comparison Report Between HUMPDGFR_P6 (SEQ ID NO:272) and PGDR_HUMAN (SEQ ID NO:267)

1. An isolated chimeric polypeptide HUMPDGFR_P6 (SEQ ID NO:272), comprising a first amino acid sequence being at least 90% homologous to MRLPGAMPALA-LKGELLLLSLLLLLEPQISQGLVVTPPG-PELVLNVSSTFVLTC SGSAPVVWERMSQEPPQE-MAKAQDGTFSSVLTLTNLTGLDTGEYFCTHNDSR GLETDERKRLYIFVPDPTVGFLP-NDAEELFIFLTEITEITIPCRVTDPQLVVTLHE KKGD-VALPVPYDHQRGFSGIFEDRSYICKT-TIGDREVDSDAYYVYRLQVSSIN VSVNAVQTVVRQGENITLMCIVIGNEV-VNFEWTYPRKESGRLVEPVTDFLLD MPYHIRSILHIP-SAELEDSGTYTCNVTESVNDHQDEKAIN-ITVVESGYVRLLGE VGTLQFAELHRSRTLQVVFEAYPPPTVL-WFKDNRTLGDSSAGEIALSTRNVSE TRYVSELTLVRVKVAEAGHYTMRAF-HEDAEVQLSFQLQINVPVRVLELSESH PDSGEQTVR-CRGRGMPQPNII-WSACRDLKRCPRELPPTLLGNSSEEESQLETN VTYWEEEQEFEVVSTLRLQHVDRPLS-VRCTLRNAVGQDTQEVIVVPH corresponding to amino acids 1-526 of PGDR_HUMAN (SEQ ID NO:267), which also corresponds to amino acids 1-526 of HUMPDGFR_P6 (SEQ ID NO:272), and a second amino acid sequence being at least 70%, optionally at least 80%, preferably at least 85%, more preferably at least 90% and most preferably at least 95% homologous to a polypeptide having the sequence CESPAS-VAPDDPNPYLNPA (SEQ ID NO:268) corresponding to amino acids 527-545 of HUMPDGFR_P6 (SEQ ID NO:272), wherein said first amino acid sequence and second amino acid sequence are contiguous and in a sequential order.

2. An isolated polypeptide for a tail of HUMPDGFR_P6 (SEQ ID NO:272), comprising a polypeptide being at least 70%, optionally at least about 80%, preferably at least about 85%, more preferably at least about 90% and most preferably at least about 95% homologous to the sequence CESPAS-VAPDDPNPYLNPA (SEQ ID NO:268) in HUMPDGFR_P6 (SEQ ID NO:272).

Thus, the present inventors have uncovered a therapeutic agent, a polypeptide homologous to SEQ ID NO:272 and/or an expressible polynucleotide homologous to SEQ ID NO:271 and/or a peptide homologous to SEQ ID NO:268 which can be used to treat decubitus ulcer, diabetic ulcer, various cancers (e.g., leukaemia), hyperlipidaemia, glomerulonephritis and renal failure, restenosis, infection, peripheral vascular disease, tissue regeneration (e.g., bone), thrombocytopenia, and wound healing. Thus is agent can be used in various therapies such as, ophthalmological, stomatological, symptomatic antidiabetic, vulnerary, radio/chemosensitizer, anticancer, cardiovascular; hypolipaemic/Antiatherosclerosis, antihypertensive, urological, antihypertensive, antiulcer, antiviral, cardiovascular, haematological, musculoskeletal, and radio/chemoprotective.

It will be appreciated that such an agent can be administered or provided to an individual in need thereof per se or as part of a pharmaceutical composition with a pharmaceutical acceptable carrier (e.g., PEG and liposomes).

While further reducing the present invention to practice, these results suggest the use of the new PDGF-R-β variant of the present invention (HUMPDGFR_P6—SEQ ID NO: 272), the polynucleotide encoding same (HUMPDGFR_T13—SEQ ID NO: 271) and/or the peptide derived from the HUMPDGFR_P6 variant (SEQ ID NO: 268) as a diagnostic marker for various cancers such as pancreatic tumors. Diagnosis according to this aspect of the present invention is effected using immunological assays [e.g., Western Blot, immunohistochemistry, FACS analysis, radio immuno assay (RIA), immunofluorescence, and the like using an antibody directed against the PDGF-R-β variant (HUMPDGFR_P6—SEQ ID NO:272)], or by nucleic acid techniques (NAT) such as RT-PCR, Northern Blot, in situ hybridization, in situ RT-PCR.

Example 31

Splice Variant of Interleukin-13 Receptor Alpha-1 Chain Precursor

Background

IL-13, a pleioytopic immune regulatory cytokine, produced predominantly by activated lymphocytes, especially Th2 cells, mast cells, basophils, NK and dentritic cells. Although IL-13 exhibits only 30% homology with IL-4 in amino acid sequence, it shares a conserved hydrophobic structural core with IL-4 and both of these cytokines share the same receptor subunit. Therefore IL-13 is able to induce nearly all biological responses generated by IL-4 (Terabe et al., 2004). Both cytokines induce IgE class switching in B cells, enhancement of monocyte/macrophage antigen presentation ability, by up-regulation of major histocompatibility complex (MHC) class II and CD23 expression, up-regulation of VCAM-1 molecules on endothelial cells and adhesion molecules on monocytes and mast cells, which contribute to enhances extravasation, mobility and trafficking of these cells. Both cytokines also have important immunosuppressive and anti-inflammatory activities on macrophages and other cells, including inhibition of pro-inflammatory cytokines like IL-1, IL-6, IL-10, IL-12, TNF-a, GM-CSF, G-CSF, and chemokines like IL-8, MIP-1, MCP-3, Eotaxin and RANTES and production of anti-inflammatory molecules. Despite these common functions of the two cytokines, not all biological properties are mutual and overlapping, which is partially due to the differential expression of IL-4 and IL-13 receptor components on various cell types and species. IL-4, but not IL-13, promotes Th2 cell differentiation, which is characterised by secretion of IL-4, IL-5, IL-9, IL-10, and IL-13 and generation of humoral immune responses (Brombacher, 2000). Recently many unique effector functions of IL-13 have been demonstrated, that distinguish it from IL-4. Resistance to most gastrointestinal nematodes is mediated by type-2 cytokine responses, in which IL-13 plays a dominant role. By regulating cell-mediated immunity, IL-13 modulates resistance to intracellular organisms including *Leishmania major, Leishmaniamexicana*, and *Listeria monocytogenes*. In the lung, IL-13 is the central mediator of allergic asthma, where it regulates eosinophilic inflammation, mucus secretion, and airway hyperresponsiveness (Wynn, 2003). IL-13 was also shown to be involved in several malignancies. Its effect in tumor growth by an autocrine manner was observed in Hodgkin's lymphoma (Terabe et al., 2004). In addition to the promotion of tumor growth, IL-13 affects the immune response to this tumor. By down-regulating type-1-immune response, IL-13 acts as a major suppressor of immunosurveillance mechanisms which are part of the host defense against tumors. Finally, IL-13 was shown to be involved in the induction of oxazolone colitis (TH2-induced ulcerative colitis), parasite-induced liver and lung fibrosis, and other cases of lung fibrosis (Terabe et al., 2004). The overlapping biological functions of IL-4 and IL-13 on some cell types are due to at least, one shared component of otherwise distinct receptors. The IL-4 receptor (IL-4R) is a heterodimeric complex comprised of an IL-4Rα-chain and the common γ chain (γc), also called the type I IL-4R. IL-4Rα-chain can dimerize with IL-13-Rα1 to form a functional IL-13 receptor, called also the type II IL-4R. This type of receptor expressed on a broad range of cell types, including hematopoitic and non hematopoitic cells, except for T cells, and can bind both IL-13 and IL-4. IL-13Rα1 can bind IL-13 but not IL-4. IL-4Rα can bind only IL-4. IL-13 binds with low affinity to the IL-13Rα1 chain, but by IL-4Rα recruitment forms the high affinity receptor for IL-13. On the other hand, IL-4 first binds to IL-4Rα, which then recruits either the IL-13Rα1 or the IL-2Rγc chain, which increases its binding affinity (Terabe et al., 2004). There is another receptor for IL-13 called IL-13α2. This receptor binds only IL-13 with relatively high affinity and seems to be a decoy. Since the IL-4Rα chain is the only component which has kinase-sensitive tyrosine residues in the cytoplasmic domain, signals from both type I and type II IL-4R are transduced by the IL-4Rα chain. Therefore, IL-13 and IL-4 primarily use the same Janus kinase (JAK)-signal transducer and activator of transcription (Stat6) pathway, although each receptor chain associates with different JAKs. When the type I or type II IL-4R is dimerized, JAKs associated with the receptor components phosphorylate additional tyrosine residues of the IL-4Rα cytoplasmic domain. This phosphorylation recruits Stat6, which is then also phosphorylated, dimerize and migrate to the nucleus to bind to certain promoters (Terabe et al., 2004).

Clinical Application

IL-13 regulates a variety of functions in immune cells. It has been shown to play a prominent role in atopic dermatitis, allergic rhinitis, pulmonary asthma and related lung injury, lung fibrosis, hepatic fibrosis induced by schistosomiasis, TH2-induced ulcerative colitis and susceptibility to *Leishmania major* infection and malignancies. Therefore, it has been hypothesized that blocking the effect of IL-13 can provide therapeutic benefit in these pathological conditions.

Splice Variant Structure

The present inventors uncovered a novel splice variant of IL-13Rα1 gene (Z40355_T1—SEQ ID NO:93; FIG. 61*a*). IL-13Rα1 splice variant T1 results from alternative splicing of the IL-13Rα1 gene, thus introducing a novel exon 5a (between exons 5 and 6), leading to an insertion of a stop codon and the generation of a truncated protein (Z40355_P2—SEQ ID NO:92, FIG. 61*b* and FIGS. 62-64). The protein coordinates on the transcript start from nucleotide 70 and end at nucleotide 789 as set forth in SEQ ID NO:93 (Z40355_T1 transcript). Alignment of the new IL-13Rα1 splice variant (variant T1; SEQ ID NO:92) with the WT protein (GenBank Accession No. P78552; I131_HUMAN; SEQ ID NO:145) revealed that the new variant encodes a 240 amino acids long protein which contains the N-terminal 225 amino acids of the wild type IL-13R, including the signal sequence (residues 1-21), almost the complete cytokine receptor common beta/gamma chain domain (CR1A) and a unique sequence of 15 amino acids at the C-terminus of the protein (GPTSPYCHIGDEVST; SEQ ID NO:94; FIG. 63). It is predicated to be a secreted protein due to the fact that it lacks the transmembrane domain.

Comparison Report Between Z40355_P2 (SEQ ID NO:92) and I131_HUMAN (SEQ ID NO:145)

1. An isolated chimeric polypeptide Z40355_P2 (SEQ ID NO:92), comprising a first amino acid sequence being at least 90% homologous to MEWPARLCGLWALLL-CAGGGGGGGAAPTETQPPVTNLSVSVENLCTVIWT WNPPEGASSNCSLWYFSHFGDKQDKKIA-PETRRSIEVPLNERICLQVGSQCST NESEKPSILVEK-CISPPEGDPESAVTELQCIWHNLSYMKC-SWLPGRNTSPDTNY TLYYWHRSLEKIHQCENIFREGQYFGCS-FDLTKVKDSSFEQHSVQIMVKDNA GKIKPSFNIV-PLTSR corresponding to amino acids 1-225 of I131_HUMAN (SEQ ID NO:145), which also corresponds to amino acids 1-225 of Z40355_P2 (SEQ ID NO:92), and a second amino acid sequence being at least 70%, optionally at least 80%, preferably at least 85%, more preferably at least 90% and most preferably at least 95% homologous to a polypeptide having the sequence GPTSPYCHIGDEVST (SEQ ID NO:94) corresponding to amino acids 226-240 of Z40355_P2 (SEQ ID NO:92), wherein said first amino acid sequence and second amino acid sequence are contiguous and in a sequential order.

2. An isolated polypeptide for a tail of Z40355_P2 (SEQ ID NO:92), comprising a polypeptide being at least 70%, optionally at least about 80%, preferably at least about 85%, more preferably at least about 90% and most preferably at least about 95% homologous to the sequence GPTSPY-CHIGDEVST (SEQ ID NO:94) in Z40355_P2 (SEQ ID NO:92).

The Therapeutic Potential of IL-13Rα1 Splice Variants

IL-13Rα1 splice variants, which is a soluble form of the receptor could serve as a powerful antagonists of IL-13-IL-13R interaction. It contains the complete CRIA, which is predicted to constitute the ligand binding region and therefore can inhibit IL-13 signaling by competing with the membrane-bound receptor for IL-13, thus preventing it from binding to the cell surface receptor and activating the membrane receptor.

IL-13 signaling pathway plays a major role in the pathogenesis of allergic diseases. Blocking of this signaling could therefore have an important therapeutic potential for the treatment of asthma, atopic dermatitis and allergic rhinitis. In addition, IL-13 has been shown to play a role in tissue fibrosis such as lung fibrosis and hepatic fibrosis induced by schistosomiasis and in TH2-induced ulcerative colitis. Inhibition of this signaling pathway can provide therapeutic advantage in these pathological conditions. Manipulation of IL-13 effector function may also prove useful in the treatment of some cancers like B-cell chronic lymphocytic leukemia and Hodgkin's disease, where IL-13 modulates apoptosis or tumor cell growth. IL-13 can also inhibit tumor immunosurveillance. As such, inhibitors of IL-13 might be effective as cancer immunotherapeutics.

Thus, the present inventors have uncovered a therapeutic agent, a polypeptide homologous to SEQ ID NO:92 and/or an expressible polynucleotide homologous to SEQ ID NO:93 and/or a peptide homologous to SEQ ID NO:94 which can be used to prevent and/or treat allergic diseases (e.g., asthma, atopic dermatitis and allergic rhinitis), tissue fibrosis (e.g., lung fibrosis and hepatic fibrosis induced by schistosomiasis and in TH2-induced ulcerative colitis), cancers (e.g., B-cell chronic lymphocytic leukemia and Hodgkin's disease), tumor immunosurveillance (i.e., serve as an immunotherapeutic agent for cancer treatment).

It will be appreciated that such an agent can be administered or provided to an individual in need thereof per se or as part of a pharmaceutical composition with a pharmaceutical acceptable carrier (e.g., PEG and liposomes).

Example 32

Splice Variant of Tissue-Type Plasminogen Activator Precursor (TPA)

Background

Tissue plasminogen activator (tPA) is a serine protease responsible for converting plasminogen into the protease plasmin. Plasmin is involved in a range of biological processes, including fibrinolysis, tissue development, and tumor invasion and metastasis. After converting plasminogen to plasmin, t-PA is subjected to cleavage by plasmin into two di-sulfide-connected chains. Both single and two-chain forms of t-PA posses full biological activity. The reaction between t-PA and fibrinogen is much more effective in the presence of fibrin-bound plasminogen. t-PA exert its enzymatic activity only upon binding fibrin which is bound to plasminogen. The selectivity of t-PA for fibrin-associated plasminogen avoids degradation of circulating fibrinogen. t-PA is abundant in the blood and is also found in organs such as the uterus, prostate, lung, ovary, muscle, heart, spleen, and liver (Robison, A. K., and D. Collen. 1987. Activation of the fibrinolytic system. Cardiol Clin 5:13.). In addition to fibrin, t-PA's enzymatic activity is also modulated by the serpin PAI-1. PAI-1 binds t-PA around amino acid 300 (Bennett, W. F., N. F. Paoni, B. A. Keyt, D. Botstein, A. J. Jones, L. Presta, F. M. Wurm, and M. J. Zoller. 1991. High resolution analysis of functional determinants on human tissue-type plasminogen activator. J Biol Chem 266:5191). Structurally, t-PA consists of an N-terminal heavy chain, which contains a finger (also designated fibronectin-like) domain, an epidermal growth factor (EGF) homologous region, and two "kringle" structures (K1, K2), while the C-terminal light chain consists of a serine protease domain. Fibrin binding has been attributed to the kringle-2 domain and to a lesser extent to the finger and EGF domains (Lee, S. G., N. Kalyan, J. Wilhelm, W. T. Hum, R. Rappaport, S. M. Cheng, S. Dheer, C. Urbano, R. W. Hartzell, M. Ronchetti-Blume, and et al. 1988. Construction and expression of hybrid plasminogen activators prepared from tissue-type plasminogen activator and urokinase-type plasminogen activator genes. J Biol Chem 263:2917). The finger and growth factor domains are also important for clearance by the liver, a process that is also regulated by t-PA glycosylation (Bennett, W. F., N. F. Paoni, B. A. Keyt, D. Botstein, A. J. Jones, L. Presta, F. M. Wurm, and M. J. Zoller. 1991. High resolution analysis of functional determinants on human tissue-type plasminogen activator. J Biol Chem 266:5191).

Clinical Applications

Coronary arterial thrombolysis is becoming an established treatment of acute myocardial infarction. Intravenous recombinant t-PA (also designated alteplase) has been proved to be an efficient therapy for acute myocardial infarction. However, the short half-life of t-PA and complications such as bleeding, especially intracranial, raised the need for developing of new agents. Second and third generation t-PAs resulting from genetic engineering of the t-PA molecule have yielded refinements in thrombolitic therapy (Smalling, R. W. 1996. Molecular biology of plasminogen activators: what are the clinical implications of drug design? Am J Cardiol 78:2). In addition to acute myocardial infarction, t-PA agonists have also been described in the pharma as neuroprotective agents.

t-PA antagonists are of potential therapeutic use in cancer and thrombocytopenia related to chemotherapy-induced injury, as well as psoriasis and hyphemia.

Splice Variants of tPA: HUMUPAA_T6 (variant T6) and HUMUPAA_R56 (Variant T9)

The present inventors uncovered two novel splice variants of the tPA gene: HUMUPAA_T6 (variant T6) and HUMUPAA_R56 (variant T9).

Splice Variant HUMUPAA_T6 (variant T6) Structure

Figure 83A:
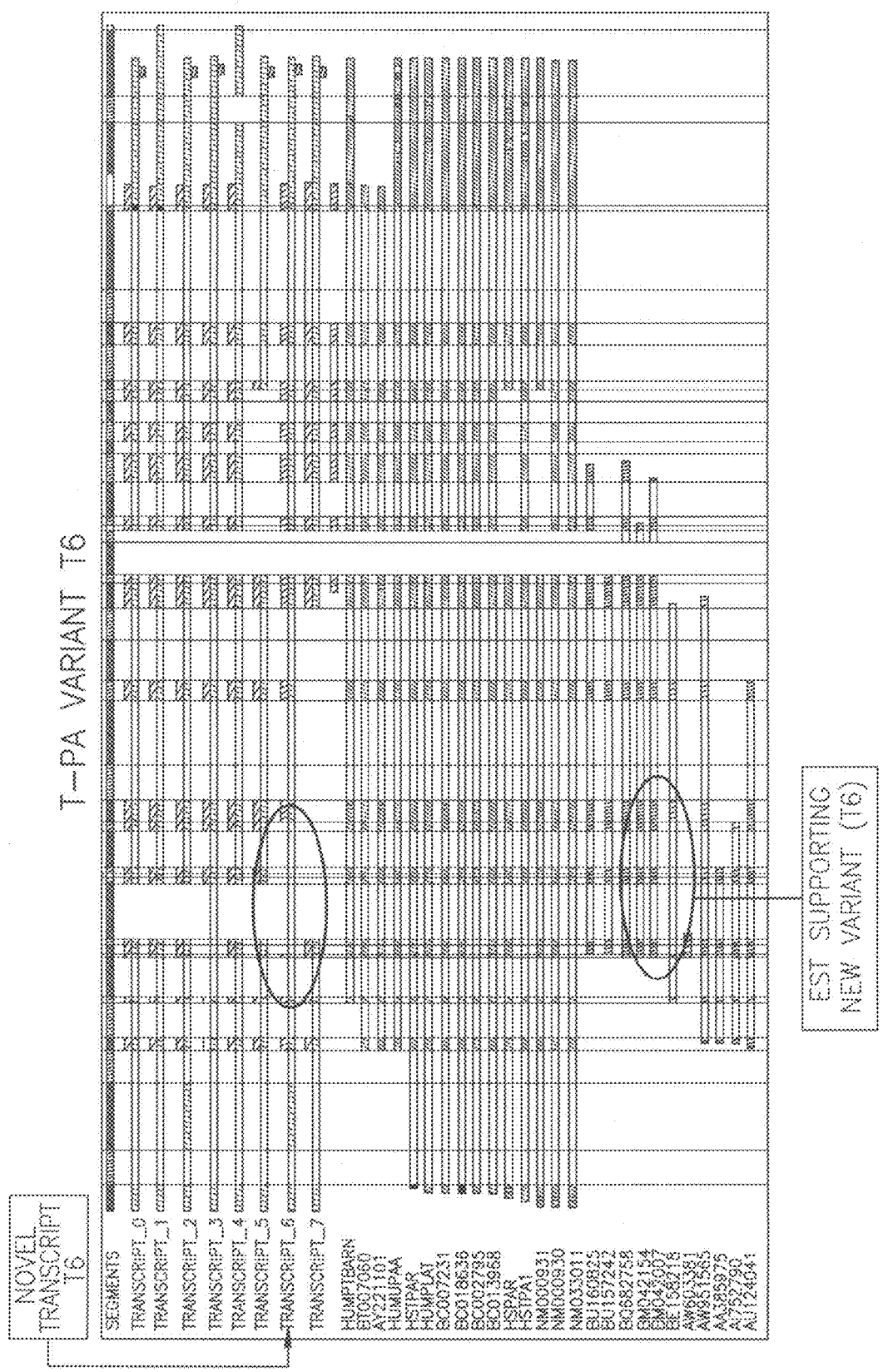
FIG. 83a is a schematic illustration depicting the graphical viewer scheme presenting the new variant of Tissue plasminogen activator (tPA) transcript_T6 as compared to the wild type mRNA. The ESTs supporting the new variant are indicated. Transcript indicated as "0" represents known mRNA. The pattern code is as in FIG. 2.

The t-PA splice variant T6 (HUMUPAA_T6—SEQ ID NO:114; HUMUPAA_P4—SEQ ID NO:113; FIGS. 82a and b, respectively) result from alternative splicing of the t-PA gene, which is caused by alternative donor site in exon 4 and alternative acceptor site in exon 6 while skipping of exon 5, and inserting a unique amino acid in the junction (FIGS. 83a, 84a, 85). The resulting protein has a deletion of amino acids 54-134 of the WT protein (TPA_HUMAN; GenBank Accession No. P00750; SEQ ID NO:150). This splice variant encodes a 482 amino acids long protein (SEQ ID NO:113), which lacks part of the finger domain, the EGF domain and part of K1, while including a full K2 and serine protease domains. The variant lacks 6 of 17 potential disulfide-bonds and 1 out of four glycosylation sites.

Comparison Report Between HUMUPAA_P4 and TPA_HUMAN

1. An isolated chimeric polypeptide HUMUPAA_P4 (SEQ ID NO:113), comprising a first amino acid sequence being at least 90% homologous to MDAMKRGLCCV-LLLCGAVFVSPSQEIHARFR-RGARSYQVICRDEKTQMIYQQ H corresponding to amino acids 1-53 of TPA_HUMAN (SEQ ID NO:150), which also corresponds to amino acids 1-53 of HUMUPAA_P4 (SEQ ID NO:113), a second amino acid sequence bridging amino acid sequence comprising of H, and a third amino acid sequence being at least 90% homologous to YRGTWSTAES-GAECTNWNSSALAQKPYSGRRPDAIR-LGLGNHNYCRNPDRD SKPWCYVFKAGKYSSEFCST-PACSEGNSDCYFGNGSAYRGTHSLTESGASCLP WNSMILIGKVYTAQNPSAQALGLGKHNY-CRNPDGDAKPWCHVLKNRRLTW EYCDVPSC-STCGLRQYSQPQERIKGGLFADIASHP-WQAAIFAKHRRSPGERFL CGGILISSCWILSAAHCFQERFP-PHHLTVILGRTYRVVPGEEEQKFEVEKYIVH KEFD-DDTYDNDIALLQLKSDSSRCAQESSV-VRTVCLPPADLQLPDWTECELSG YGKHEALSPFYSERLKEAHVRLYPSS-RCTSQHLLNRTVTDNMLCAGDTRSGG PQANLHD-ACQGDSGGPLVCLNDGRMTLVGI-ISWGLGCGQKDVPGVYTKVTN YLDWIRDNMRP corresponding to amino acids 135-562 of TPA_HUMAN (SEQ ID NO:150), which also corresponds to amino acids 55-482 of HUMUPAA_P4 (SEQ ID NO:113), wherein said first amino acid sequence, second amino acid sequence and third amino acid sequence are contiguous and in a sequential order.

2. An isolated polypeptide for an edge portion of HUMUPAA_P4 (SEQ ID NO:113), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise HHY having a structure as follows [numbering according to HUMUPAA_P4 (SEQ ID NO:113)]: a sequence starting from any of amino acid numbers 53-x to 53; and ending at any of amino acid numbers 55+((n−2)−x), in which x varies from 0 to n−2.

Splice Variant HUMUPAA_R56 (variant T9) Structure

Figure 83B:
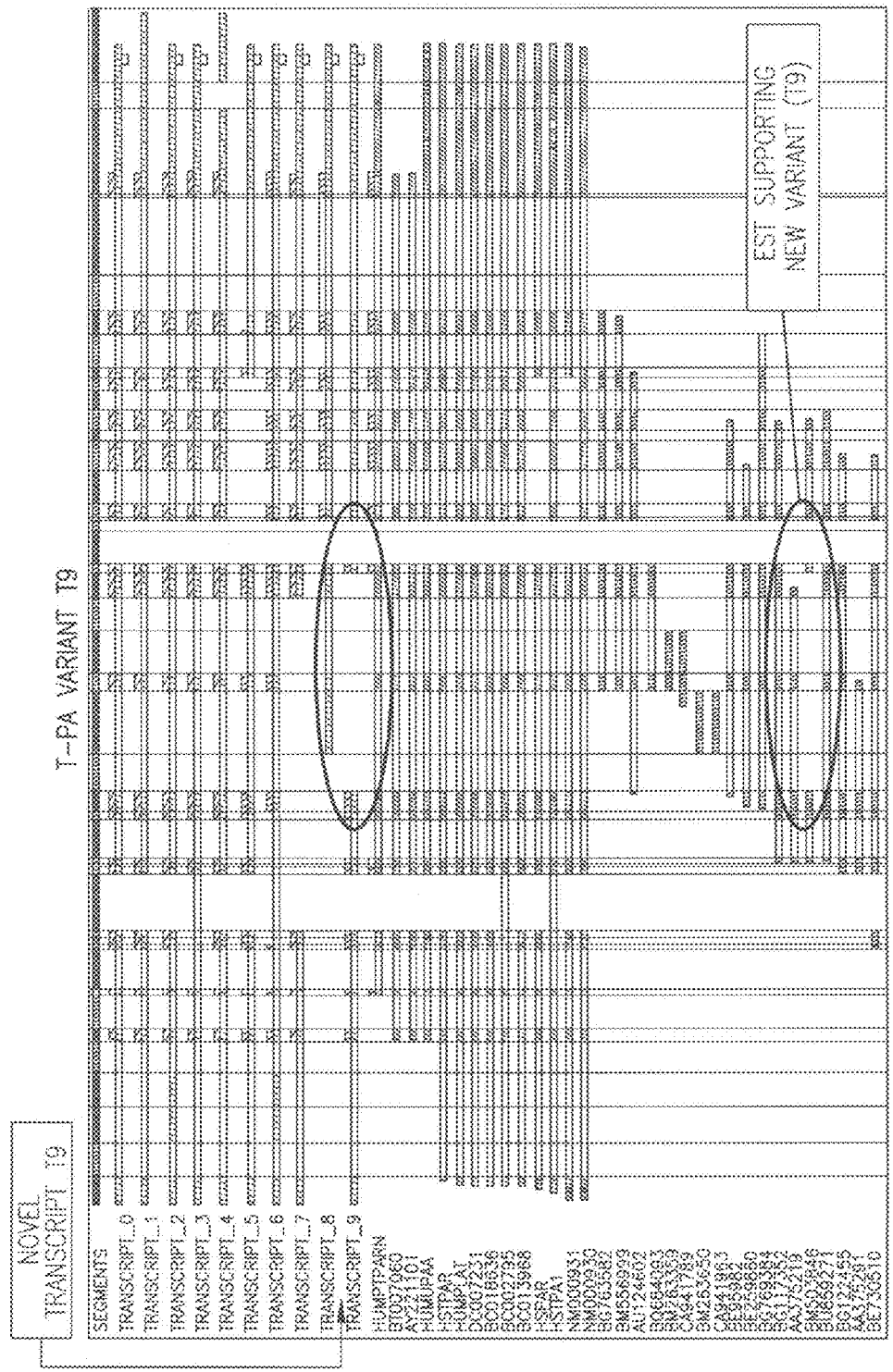
FIG. 83b is a schematic illustration depicting the graphical viewer scheme presenting the new variant of Tissue plasminogen activator (tPA) transcript_T9 as compared to the wild type mRNA. The ESTs supporting the new variant are indicated. Transcript indicated as "0" represents known mRNA. The pattern code is as in FIG. 2.

The t-PA splice variant T9 (HUMUPAA_R56—SEQ ID NO:116; HUMUPAA_X24—SEQ ID NO:115, FIGS. 82c and d, respectively) result from alternative splicing of the t-PA gene, which is caused by alternative acceptor site in exon 8 while skipping exon 7 (FIGS. 83b, 84b, 85). The resulting truncated protein encompasses 208 amino acids (SEQ ID NO:115) of them the first 180 amino acids are identical to the wild type protein (SEQ ID NO:150) and 28 unique amino acids (TPVPRHWAWANIITAGILMGMPSPGATC; SEQ ID NO:117). It contains a complete finger and EGF domains and a partial kringle-1 while lacking K2 and serine protease domains. It has most of the potential disulfide-bonds relevant to the domains it encompasses except for one, and includes the relevant glycosylation sites.

Comparison Report Between HUMUPAA_X24 (SEQ ID NO:115) and TPA_HUMAN (SEQ ID NO:150)

1. An isolated chimeric polypeptide HUMUPAA_X24 (SEQ ID NO:115), comprising a first amino acid sequence being at least 90% homologous to MDAMKRGLCCVLLLCGAVFVSPSQEIHARFR-RGARSYQVICRDEKTQMIYQQ HQSWLRPVLRSN-RVEYCWCNSGRAQCHSVPVKSCSEPRCFNGGTCQQ-ALYF SDFVCQCPEGFAGKCCEIDTRAT-CYEDQGISYRGTWSTAESGAECTNWNSSA LAQK-PYSGRRPDAIRLGLGNHNYCR corresponding to amino acids 1-180 of TPA_HUMAN (SEQ ID NO:150), which also corresponds to amino acids 1-180 of HUMUPAA_X24 (SEQ ID NO:115), and a second amino acid sequence being at least 70%, optionally at least 80%, preferably at least 85%, more preferably at least 90% and most preferably at least 95% homologous to a polypeptide having the sequence TPVPRHWAWANIITAGILMGMPSPGATC (SEQ ID NO:117) corresponding to amino acids 181-208 of HUMUPAA_X24 (SEQ ID NO:115), wherein said first amino acid sequence and second amino acid sequence are contiguous and in a sequential order.

2. An isolated polypeptide for a tail of HUMUPAA_X24 (SEQ ID NO:115), comprising a polypeptide being at least 70%, optionally at least about 80%, preferably at least about 85%, more preferably at least about 90% and most preferably at least about 95% homologous to the sequence TPVPRHWAWANIITAGILMGMPSPGATC (SEQ ID NO:117) in HUMUPAA_X24 (SEQ ID NO:115).

Therapeutic Application of the Splice Variant

Studies of deletion mutants of t-PA have demonstrated that the K2 domain and the protease domain are sufficient to exert plasminogen activator activity of t-PA (van Zonneveld, A. J., H. Veerman, and H. Pannekoek. 1986. Autonomous functions of structural domains on human tissue-type plasminogen activator. Proc Natl Acad Sci U S A 83:4670). In addition, the finger and EGF domains, which are involved in fibrin binding to a lesser extent than K2, are also important for t-PA's clearance by the liver (Bennett, W. F., N. F. Paoni, B. A. Keyt, D. Botstein, A. J. Jones, L. Presta, F. M. Wurm, and M. J. Zoller. 1991. High resolution analysis of functional determinants on human tissue-type plasminogen activator. J Biol Chem 266:5191). Concomitantly, new thrombolytic agents have been described: n-PA, which is a deletion mutant lacking the finger and EGF domains and bearing a point mutation on amino acid 152, and r-PA, which lacks the finger, EGF, and K1 domains, have been shown to have an improved lytic activity in animal models and a more extended half-life comparing to t-PA (Smalling, R. W. 1996. Molecular biology of plasminogen activators: what are the clinical implications of drug design? Am J Cardiol 78:2). Based on these findings, the t-PA splice variant T6 (SEQ ID NO:113) is predicted to be able to bind fibrin via K2 and to exert t-PA activity. Furthermore, as it lacks the finger and EGF domains, it is predicted to be less susceptible to clearance in the liver and thus, it might have a longer half-life than the wild type protein. Altogether, these data support a role for T6 as an agonist of t-PA activity, however, similar to n-PA and r-PA, it might have a reduced fibrin affinity (Smalling, R. W. 1996. Molecular biology of plasminogen activators: what are the clinical implications of drug design? Am J Cardiol 78:2).

The T9 variant of t-PA (SEQ ID NO:115) is a truncated protein that posses only the finger and EGF domains. These domains can bind, although with low efficiency, to fibrin (van Zonneveld, A. J., H. Veerman, and H. Pannekoek. 1986. Autonomous functions of structural domains on human tissue-type plasminogen activator. Proc Natl Acad Sci USA 83:4670), however in the absence of the protease domain such binding is unlikely to result in t-PA activity. Accordingly, T9 is predicted to compete for fibrin binding and can serve as a weak antagonist for t-PA.

While reducing the present invention to practice, and without being bound to any theory, the present inventors have uncovered a therapeutic agent, a polypeptide homologous to SEQ ID NO:113 and/or an expressible polynucleotide homologous to SEQ ID NO:114 which can be used as a t-PA agonist to treat acute myocardial infarction and to serve as a neuroprotective agent.

While further reducing the present invention to practice, and without being bound to any theory, the present inventors have uncovered a therapeutic agent, a polypeptide homologous to SEQ ID NO:115 and/or an expressible polynucleotide homologous to SEQ ID NO:116, and/or a peptide homologous to SEQ ID NO:117 which can be used as a t-PA antagonist to prevent and/or treat cancer, thrombocytopenia related to chemotherapy-induced injury, psoriasis and hyphemia.

It will be appreciated that such agents can be administered or provided to an individual in need thereof per se or as part of a pharmaceutical composition with a pharmaceutical acceptable carrier (e.g., PEG and liposomes).

Example 33

Splice Variant of L-Selectin Precursor

Background

L-selectin (CD62L, LECAM-1, LAM-1) is a member of the selectins (CD62) family, which also includes P-selectin (CD62P, GMP140, PADGEM) and E-selectin (CD62E, ELAM-1). The selectins regulate the first reversible interaction between leukocytes and the endothelium, whereas the second and third phases of extravasation are mediated by integrins. L-selectin was originally defined as a lymphocyte membrane molecule which mediates the attachment of lymphocytes to specialized lymph node postcapillary venules (the 'high endothelial venules', HEV). Later on, L-selectin was found to be involved also in leukocyte homing to sites of inflammation (Tedder et al. 1993).

Structurally, each member of the selectin family contains an N-terminal C-type lectin domain (also designated carbohydrate-recognition domain, CRD) followed by an epidermal growth factor (EGF)-like domain, short consensus repeat (SCR, also designated sushi, two in L-selectin), a transmembrane domain, and a short cytoplasmic tail. Biochemical studies revealed that L-selectin is heavily glycosylated (Sackstein, 1997).

L-selectin is expressed on the earliest hematopoitic progenitor (CD34+) cells, by very immature thymocytes and early B cell precursors, and by mature B and T lymphocytes and mature granulocytes and monocytes. The expression of L-selectin on the cell surface of leukocytes is tightly regulated: in response to a chemoattractant a transient increase in L-selectin activity (but not cell surface expression) is observed, which is followed by a rapid (within minutes) proteolytic shedding of the molecule from the cell surface (Rosen and Bertozzi, 1994). The shedding is mediated by a cystein metalloprotease, presumably the TNFα converting enzyme (TACE), between Lys321 and Ser322 in a region that links the second CSR and the transmembrane domain (Jasuja et al., 2000; Migaki et al., 1995). Concomitantly, high levels of L-selectin on cell surface are found in peripheral neutrophils while in the inflammatory site its surface level is very low. It was proposed that L-selectin is essential for rolling and firm adhesion of leukocytes, however, its shedding allows the leukocyte to break its tight bonds with the vascular endothelium and proceed with extravasation. Additionally, the shed molecule is present in the extracellular fluid and can inhibit specific cell attachment of lymphocytes to cytokine-activated endothelium and may serve as a regulator of leukocyte attachment to endothelium (Jutila, 1994; Tedder et al., 1993).

The ligands for L-selectin are E-selectin, GlyCAM-1, CD34 and MAdCAM-1 all of which are expressed on endothelial cells. CD34 is expressed also by progenitor cells and its interaction with L-selectin involves in progenitor cell maturation. These molecules have extracellular domains with a mucin organization, i.e. serin/threonin-rich regions that are densely associated with O-linked fucosylaed or sialylated carbohydrate chains. The mucin-associated oligosaccharides are recognized and bound by the selectin (Rosen and Bertozzi, 1994). The avidity of interaction between the selectin and the mucin-like ligand result from oligomerization of the L-selectin molecules on the leukocyte surface and is influenced by the density of the ligand on the opposed cell.

Clinical Applications

Leukocyte-endothelial interactions are critical for host defense; however, in some disease state leukocyte-endothelial interactions may be deleterious to the host. For example, activation signals generated during ischemia may trigger vigorous inflammatory response during reperfusion, provoking greater tissue damage then the initial ischemic insult. In diseases such as rheumatoid arthritis, psoriasis, asthma, atherosclerosis, or multiple sclerosis, mononuclear leukocytes may contribute to secondary tissue damage (Harlan et al., 2002). Downregulation of L-selectin shedding, resulting in continued adherence of leukocytes to endothelium, possibly causing further damage and immune complex deposition, have been described in lupus (Bloom et al., 2002). High levels of soluble L-selectin were found in the blood of ulcerative colitis but not Crohn's patients (Seidelin et al., 1998; Elewaut et al., 1998). L-selectin antagonists were reported to be on phase II of clinical trials for treatment of colitis. Anti-L-selectin antibodies have been implicated in a baboon model of traumatic shock. This resulted in reduced trauma-associated organ damage and mortality, and had beneficial effects on long-term survival (Shlag et al., 1999). Altogether, selectins might be ideal targets for treatment of acute and chronic inflammatory reactions as their primary role appears to be specific as it is restricted to endothelial cells and platelet adhesion to leukocytes during inflammation or leukocyte homing. Additionally, constitutive T cell L-selectin and upregulated L-selectin ligands expression were found in rejected grafts (Jones et al., 2003). Concomitantly, L-selectin antagonist are in phase II of clinical trials for transplant rejection. Another biological process that may involve selectins is the adhesion of circulating tumor cells to endothelium in cancer metastasis of different tumor types. Measurement of selectins could thus be useful for prognosis, and manipulation of their levels could lead to new cancer therapies (Krause and Turner, 1999).

New L-Selectin Structure Splice Variants: T2, T3, and T6

The present inventors uncovered a novel splice variants of L-selectin (SEQ ID NOs: 68, 69, 71, 72, 74 and 75, FIGS. 41a-f).

L-Selectin Splice Variant T2

Figure 42A:
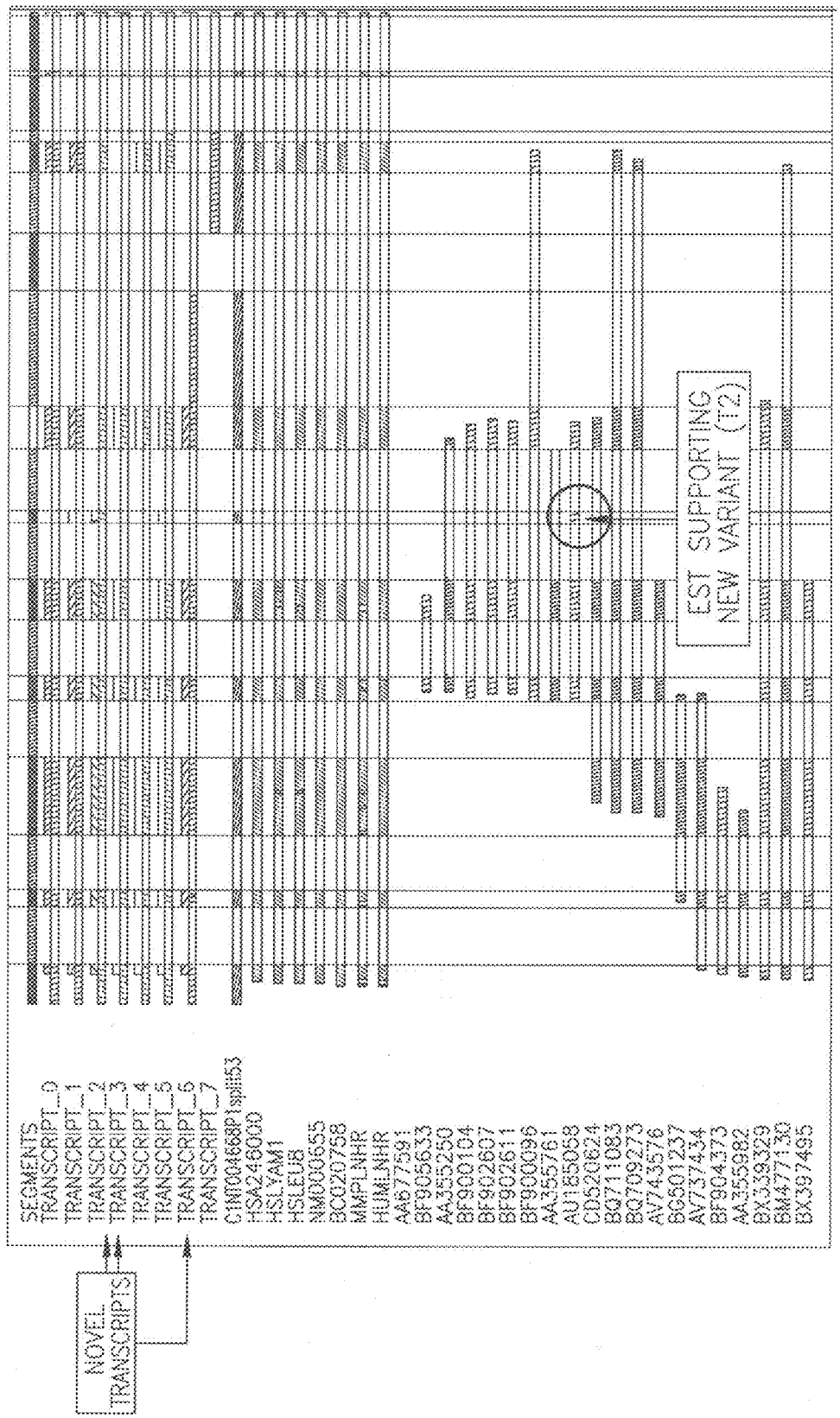
Figure 44:
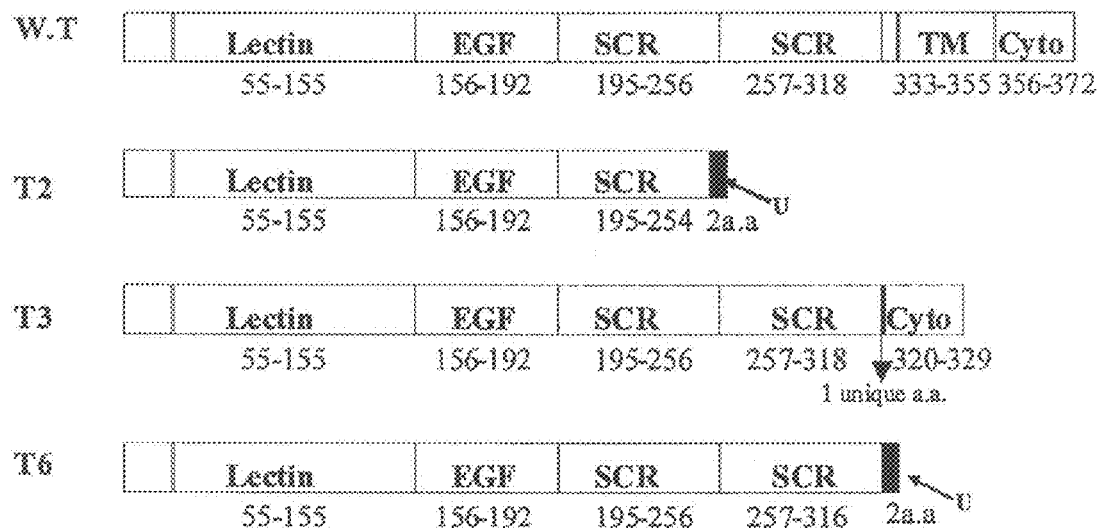
FIG. 44 is a schematic illustration showing the protein domain structure of wild-type L-Selectin (SwissProt locus: LEM1_HUMAN; SEQ ID NO:140) and the variants of the present invention (SEQ ID NOs: 68, 71 and 74). Unique region is indicated by U and arrow (SEQ ID NOs: 70, 73, and 76).

L-selectin splice variant T2 (MMPLNHR_T2—SEQ ID NO:69; MMPLNHR_P2—SEQ ID NO:68, FIGS. 41a and b, respectively) results from alternative splicing of the L-selectin gene, thus introducing a new exon (exon 5a), causing the insertion of a stop codon, that result in a truncated L-selectin protein (FIGS. 42a, 43a, 44). The variant protein thus created is a 257 amino acids long truncated protein (SEQ ID NO:68), which contains the N-terminal 255 amino acids of wild type L-selectin, followed by 2 unique amino acids (GE; SEQ ID NO: 70). It contains the C-type lectin domain, the EGF-like domain, the first SCRs (also designated sushi domains), while it lacks the second SCR, the TM and the intracellular portion. The variant has all the potential disulfide-bonds and glycosylation sites relevant to the domains it encompasses.

Comparison Report Between MMPLNHR_P2 (SEQ ID NO:68) and LEM__1_HUMAN (SEQ ID NO:140)

1. An isolated chimeric polypeptide MMPLNHR_P2, comprising a first amino acid sequence being at least 90% homologous to MIFPWKCQSTQRDLWNIFKLWGWTM-LCCDFLAHHGTDCWTYHYSEKPMN WQRARRFCRD-NYTDLVAIQNKAEIEYLEKTLPFSRSYY-WIGIRKIGGIWTWVG TNKSLTEEAENWGDGEPNNKKNKED-CVEIYIKRNKDAGKWNDDACHKLKA ALCYTASCQP-WSCSGHGECVEIINNYTCNCDVGYYG-PQCQFVIQCEPLEAPEL GTMDCTHPLGNFSFSSQCAFSCSEGT-NLTGIEETTCGPFGNWSSPEPTCQ corresponding to amino acids 1-255 of LEM1_HUMAN, which also corresponds to amino acids 1-255 of MMPLNHR_P2, and a second amino acid sequence being at least 70%, optionally at least 80%, preferably at least 85%, more preferably at least 90% and most preferably at least 95% homologous to a polypeptide having the sequence GE corresponding to amino acids 256-257 of MMPLNHR_P2, wherein said first amino acid sequence and second amino acid sequence are contiguous and in a sequential order.

Comparison Report Between MMPLNHR_P2 and LEM1_HUMAN

1. An isolated chimeric polypeptide MMPLNHR_P2, comprising a first amino acid sequence being at least 90% homologous to MIFPWKCQSTQRDLWNIFKLWGWTM-LCCDFLAHHGTDCWTYHYSEKPMN WQRARRFCRD-NYTDLVAIQNKAEIEYLEKTLPFSRSYY-WIGIRKIGGIWTWVG TNKSLTEEAENWGDGEPNNKKNKED-
CVEIYIKRNKDAGKWNDDACHKLKA ALCYTASCQP-
WSCSGHGECVEIINNYTCNCDVGYYG-
PQCQFVIQCEPLEAPEL
GTMDCTHPLGNFSFSSQCAFSCSEGT-
NLTGIEETTCGPFGNWSSPEPTCQ corresponding to amino acids 1-255 of LEM1_HUMAN, which also corresponds to amino acids 1-255 of MMPLNHR_P2, and a second amino acid sequence being at least 70%, optionally at least 80%, preferably at least 85%, more preferably at least 90% and most preferably at least 95% homologous to a polypeptide having the sequence GE corresponding to amino acids 256-257 of MMPLNHR_P2, wherein said first amino acid sequence and second amino acid sequence are contiguous and in a sequential order.

L-Selectin Splice Variant T3

L-selectin splice variant T3 (MMPLNHR_T3—SEQ ID NO:72, MMPLNHR_P3—SEQ ID NO:71, FIGS. 41c and d, respectively) result from alternative splicing of the L-selectin, thus leading to the skipping of exon 7 and the generation of a protein lacking amino acids 317-361 of wild type L-selectin, while introducing one novel amino acid in the junction (new edge—SEQ ID NO:73; FIGS. 42, 43b, 44). This splice variant encodes a 329 amino acids long protein which contains the C-type lectin domain, the EGF-like domain, both SCRs, and the intracellular domain, while lacking the TM. The variant has all the potential disulfide-bonds and glycosylation sites relevant to the domains it encompasses.

Comparison Report Between MMPLNHR_P3 and LEM1_HUMAN

1. An isolated chimeric polypeptide MMPLNHR_P3, comprising a first amino acid sequence being at least 90% homologous to MIFPWKCQSTQRDLWNIFKLWGWTM-
LCCDFLAHHGTDCWTYHYSEKPMN WQRARRFCRD-
NYTDLVAIQNKAEIEYLEKTLPFSRSYY-
WIGIRKIGGIWTWVG
TNKSLTEEAENWGDGEPNNKKNKED-
CVEIYIKRNKDAGKWNDDACHKLKA ALCYTASCQP-
WSCSGHGECVEIINNYTCNCDVGYYG-
PQCQFVIQCEPLEAPEL
GTMDCTHPLGNFSFSSQCAFSCSEGT-
NLTGIEETTCGPFGNWSSPEPTCQVIQC EPLSAP-
DLGIMNCSHPLASFSFTSACTFICSEG-
TELIGKKKTICESSGIWSNPSPIC Q corresponding to amino acids 1-317 of LEM1_HUMAN, which also corresponds to amino acids 1-317 of MMPLNHR_P3, a second amino acid sequence bridging amino acid sequence comprising of S, and a third amino acid sequence being at least 90% homologous to KKSKRSMNDPY corresponding to amino acids 362-372 of LEM1_HUMAN, which also corresponds to amino acids 319-329 of MMPLNHR_P3, wherein said first amino acid sequence, second amino acid sequence and third amino acid sequence are contiguous and in a sequential order.

2. An isolated polypeptide for an edge portion of MMPLN-HR_P3, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QSK having a structure as follows (numbering according to MMPLNHR_P3): a sequence starting from any of amino acid numbers 317-x to 317; and ending at any of amino acid numbers 319+((n−2)−x), in which x varies from 0 to n−2.

The T6 Splice Variant

The T6 splice variant (MMPLNHR_T6—SEQ ID NO:75; MMPLNHR_P6-SEQ ID NO:74, FIGS. 41e and f, respectively) obtained by the alternative splicing of the L-selectin gene result in extension of exon 6 leading to an insertion of a stop codon and the generation of a truncated protein (FIGS. 42, 43c, 44). This splice variant encodes 319 amino acids long protein, which contains 317 amino acids of the wild type sequence, and 2 unique amino acids (SE—SEQ ID NO:76). It encompasses the C-type lectin domain, the EGF-like domain, and both SCRs while it lacks the TM and the cytoplasmic domain. The variant has all the potential disulfide-bonds and glycosylation sites relevant to the domains it encompasses.

Comparison Report Between MMPLNHR_P6 and LEM1_HUMAN

1. An isolated chimeric polypeptide MMPLNHR_P6, comprising a first amino acid sequence being at least 90% homologous to MIFPWKCQSTQRDLWNIFKLWGWTM-
LCCDFLAHHGTDCWTYHYSEKPMN WQRARRFCRD-
NYTDLVAIQNKAEIEYLEKTLPFSRSYY-
WIGIRKIGGIWTWVG
TNKSLTEEAENWGDGEPNNKKNKED-
CVEIYIKRNKDAGKWNDDACHKLKA ALCYTASCQP-
WSCSGHGECVEIINNYTCNCDVGYYG-
PQCQFVIQCEPLEAPEL
GTMDCTHPLGNFSFSSQCAFSCSEGT-
NLTGIEETTCGPFGNWSSPEPTCQVIQC EPLSAP-
DLGIMNCSHPLASFSFTSACTFICSEG-
TELIGKKKTICESSGIWSNPSPIC Q corresponding to amino acids 1-317 of LEM1_HUMAN, which also corresponds to amino acids 1-317 of MMPLNHR_P6, and a second amino acid sequence being at least 70%, optionally at least 80%, preferably at least 85%, more preferably at least 90% and most preferably at least 95% homologous to a polypeptide having the sequence SE corresponding to amino acids 318-319 of MMPLNHR_P6, wherein said first amino acid sequence and second amino acid sequence are contiguous and in a sequential order.

Therapeutic Application of the Splice Variants

Splice variant T2 contains the lectin domain, which is responsible for interaction with L-selectin ligands, the EGF-like domain, and the first SCR. It is predicted to be a soluble protein as it lacks the TM domain and will thus serve as an antagonist for L-selectin interaction with its ligands.

Splice variant T3 consists of all the L-selectin domains but lacks the TM and the N-terminus portion of the cytoplasmic domain as a result of exon skipping. It is predicted to be a soluble protein that will antagonize L-selectin function by competing for its ligand.

Splice variant T6 is a truncated protein that lacks the TM and the cytoplasmic domain. It is thus predicted to be a soluble protein that will antagonize L-selectin function by competing for its ligand. The protein resulting from this variant (excluding the 2 unique amino acids) is analogous to the naturally occurring soluble L-selectin that result from the shedding of the membrane bound L-selectin at position 321.

Antagonists for L-selectin activity have been described in phase II of clinical trials for treatment of inflammation, psoriasis, traumatic-shock, asthma, transplant rejection, ulcerative colitis, irritable bowel syndrome, and atopic eczema.

Thus, the present inventors have uncovered a therapeutic agent, a polypeptide homologous to SEQ ID NO:68, 71 or 74 and/or an expressible polynucleotide homologous to SEQ ID NO:69, 72 or 75 which can serve as an antagonist of L-selectin function and thus can prevent and/or treat inflammation (e.g., chronic inflammatory), psoriasis, traumatic-shock, asthma, transplant rejection, ulcerative colitis, irritable bowel syndrome, and atopic eczema, rheumatoid arthritis, atherosclerosis, multiple sclerosis, and cancer metastasis.

It will be appreciated that such an agent can be administered or provided to an individual in need thereof per se or as part of a pharmaceutical composition with a pharmaceutical acceptable carrier (e.g., PEG and liposomes).

Since L-selectin involves in the adhesion of circulating tumor cells to endothelium in cancer metastasis of different tumor types, the new L-selectin variants of the present invention (T2, T3 and/or T6; SEQ ID NOs:68, 69, 71, 72, 74, 75) can be used as diagnostic markers for determining prognosis of cancer as well as markers for the efficacy of new cancer therapies. Diagnosis according to this aspect of the present invention is effected using immunological assays [e.g., Western Blot, immunohistochemistry, FACS analysis, radio immuno assay (RIA), immunofluorescence, and the like using an antibody directed against the L-selectin variants (SEQ ID NO:68, 71 and/or 74], or by nucleic acid techniques (NAT) such as RT-PCR, Northern Blot, in situ hybridization, in situ RT-PCR.

Example 34

Splice Variant of Elastase IIIb Precursor

Background

The elastase IIIB precursor (Protease E; GenBank Accession No. P08861; EL3B_HUMAN; ELAS; ELA3A; ELA3B) is an extracellular protein which belongs to the peptidase S1 family (the elastase subfamily) and exhibits proteolysis, peptidolysis and trypsin activity, although it does not hydrolyze elastin. It exhibits specificity towards Alanine and cleaves the Ala-|-Xaa bond. The elastase IIIB precursor is overexpressed in endocrine tissues and particularly in the pancreas and can be used as a marker for proliferation of this tissue or as a marker for pathological de-differentiation of this tissue or tissue damage. In addition, since elastase IIIB is overexpressed in pancreatic tumors it can be used as a marker for these pathologies.

Clinical Applications

Elastase IIIb has been implicated in various disease, disorders or conditions such as asthma, thrombosis, psoriasis, pancreatitis, cystic fibrosis, general emphysema, infection (e.g., respiratory tract infection. sepsis), reperfusion injury, chronic bronchitis, pulmonary fibrosis, HIV/AIDS, haemorrhage, rheumatoid arthritis, inflammation, peripheral vascular disease, respiratory disease, alpha-1 antitrypsin deficiency, chronic obstructive pulmonary disease.

Splice Variant HUMPRE_T3 (SEQ ID NO:273) Encodes a New Secreted Form of the Elastase IIIB, HUMPRE_P4 (SEQ ID NO:274)

The present inventors have uncovered a new elastase IIIB variant [HUMPRE_T3—SEQ ID NO:273; HUMPRE_P4—SEQ ID NO:274]. The protein coordinates on the transcript start from nucleotide 147 and end at nucleotide 833 as set forth in SEQ ID NO:273 (HUMPRE_T3 transcript).

Alignment of the new elastase IIIB variant (HUMPRE_P4—SEQ ID NO:274) with the WT protein (GenBank Accession No. P08861; SEQ ID NO:328) revealed that the new variant includes the first 214 amino acids as of the WT protein (GenBank Accession No. P08861) followed by a unique 15 amino acid sequence [EAHGVHSSLRLHRLD (SEQ ID NO:329), FIG. 119]. The new variant uncovered by the present invention includes 3 out of 5 potential disulfide bonds and one glycosylation site as in the WT and is lacking the Peptidase 51 chymotrypsin (IPR001254), Peptidase S1A, chymotrypsin (IPR001314) domains of the WT protein and thus is expected to be a non-functional elestase Mb variant.

Comparison Report Between HUMPRE_P4 (SEQ ID NO:274) and EL3B_HUMAN (SEQ ID NO:328)

1. An isolated chimeric polypeptide HUMPRE_P4 (SEQ ID NO:274), comprising a first amino acid sequence being at least 90% homologous to MMLRLLSSLLLVAVASGYG-PPSSRPSSRVVNGEDAVPYSWPWQVSLQYEKS GSFYHTCGGSLIAPDWVVTAGHCISSS-WTYQVVLGEYDRAVKEGPEQVIPINS GDLFVHPL-WNRSCVACGNDIALIKLSRSAQLG-DAVQLASLPPAGDILPNETPC YITGWGRLYTNGPLPDKLQEALLPV-VDYEHCSRNWWGSSVKKTMVCAGG DIRSGCN corresponding to amino acids 1-214 of EL3B_HUMAN (SEQ ID NO:328), which also corresponds to amino acids 1-214 of HUMPRE_P4 (SEQ ID NO:274), and a second amino acid sequence being at least 70%, optionally at least 80%, preferably at least 85%, more preferably at least 90% and most preferably at least 95% homologous to a polypeptide having the sequence EAHGVHSSLRLHRLD (SEQ ID NO:329) corresponding to amino acids 215-229 of HUMPRE_P4 (SEQ ID NO:274), wherein said first amino acid sequence and second amino acid sequence are contiguous and in a sequential order.

2. An isolated polypeptide for a tail of HUMPRE_P4 (SEQ ID NO:274), comprising a polypeptide being at least 70%, optionally at least about 80%, preferably at least about 85%, more preferably at least about 90% and most preferably at least about 95% homologous to the sequence EAHGVHSS-LRLHRLD (SEQ ID NO:329) in HUMPRE_P4 (SEQ ID NO:274).

Since the elestase Mb variant of the present invention lacks the functional domains it can compete with the endogenous elestase IIIb and interfere with its various activities.

Thus, the present inventors have uncovered a therapeutic agent, a polypeptide homologous to SEQ ID NO:274 and/or an expressible polynucleotide homologous to SEQ ID NO:273 and/or a peptide homologous to SEQ ID NO:329 which can be used as an anti-inflammatory, antiasthma, anticoagulant, antithrombotic, cardiovascular. hypolipaemic/antiatherosclerosis, respiratory, septic shock treatment, antiarthritic, antipsoriasis, COPD treatment, cognition enhancer, cystic fibrosis treatment, cytokine, dermatological, GI inflammatory/bowel disorders, haemostatic, lung surfactant, neuroprotective, ophthalmological, stomatological, urological, peripheral vasodilator, systemic vasoprotective, vulnerary agent.

It will be appreciated that such an agent can be administered or provided to an individual in need thereof per se or as part of a pharmaceutical composition with a pharmaceutical acceptable carrier (e.g., PEG and liposomes).

While further reducing the present invention to practice, these results suggest the use of the new elastase Mb variant of the present invention (HUMPRE_P4—SEQ ID NO:274), the polynucleotide encoding same (HUMPRE_T3—SEQ ID NO:273) and/or the peptide derived from the elastase Mb variant (SEQ ID NO:329) as a diagnostic marker for pancreas proliferation or de-differentiation, as well as pancreatic tumors. Diagnosis according to this aspect of the present invention is effected using immunological assays [e.g., Western Blot, immunohistochemistry, FACS analysis, radio immuno assay (RIA), immunofluorescence, and the like using an antibody directed against the (HUMPRE_P4 variant (SEQ ID NO:274)], nucleic acid techniques (NAT) such as RT-PCR, Northern Blot, in situ hybridization, in situ RT-PCR.

Example 35

Atrial Natriuretic Peptide Receptor B

Background

Atrial natriuretic peptide receptor B, also called ANP-B, ANPRB, GC-B, Guanylate cyclase, NPR-B, encoded by the gene called NPR2 (ANPRB), is one of two integral type I membrane receptors for natriuretic peptides. ANP-B contain five functional domains: an extracellular ligand-binding domain, a single membrane-spanning region, and intracellularly a protein kinase homology domain), an helical hinge region involved in oligomerization, and a carboxyl-terminal guanylyl cyclase catalytic domain. ANP-B is the primary receptor for C-type natriuretic peptide (CNP), which upon ligand binding exhibits greatly increased guanylyl cyclase activity. The receptor is only weakly sensitive to by Brain Natriuretic peptide (BNP) and Atriuretic peptide (ANP) (Vanderheyden et al, 2004, The European J Heart failure, 6:261-168). Guanylyl cyclases (GCs) are enzymes that convert guanosine-5'-triphosphate (GTP) to cyclic guanosine-3', 5'-monophosphate (cGMP). Receptor dimerization is essential for the activation of the catalytic domain. The second messenger cGMP participates in signaling by (1) stimulating the activity of kinases that belong to the protein kinase G family, (2) altering the conductance of cGMP-gated ion channels and (3) changing the activity of cGMP-regulated phosphodiesterases, and thereby modifies cellular functions. The glycosylation of residues located at the N-terminal end of the extracellular domain of the Natriuretic Peptide receptors plays a role in ligand binding (Kuhn, M 2003, Circ. Res, 93:700-709).

Natriuretic peptides and their receptors possess potent natriuretic, diuretic and vasodilating activities, and have important roles in regulation of body fluid and electrolyte homeostasis, and blood pressure control, thereby playing an important role in renal and cardiovascular physiology (Kuhn, 2004, Basic Res. Cardiol, 99:76-82; Vanderheyden et al, 2004 15:261-8). They are also known by their expression and physiological activity in various tissues other than cardiovascular system. The primary ligand of ANP-B, CNP is expressed mostly in the central nervous system and in the vascular endothelium. CNP is produced by most of the major endocrine glands, including the hypothalamus and anterior pituitary. The relative abundance of the ANP-B receptor in these glands suggests that CNP is a local neuroendocrine regulator. CNP is mainly produced by vascular endothelial cells and may act locally as an autocrine/paracrine regulator of vascular tone and cell growth at the vascular and venous levels. It potently inhibits the proliferation of vascular smooth muscle cells but stimulates endothelial cell growth and migration, and might therefore modulate vascular regeneration. CNP is more potent than ANP in eliciting smooth muscle relaxation, but it is less potent inducer of diuresis and natriuresis. Thus in the cardiovascular system CNP is likely to have primary local roles in the blood vessel wall rather than as a circulating natriuretic hormone. In cardiac fibroblasts ANP-B is the predominant receptor that could mediate the antiproliferative response in fibroblasts. CNP has been postulated to be a local regulator of ACE activity, and inhibition of angiotensin II formation reduces vascular hypertrophy and remodeling. CNP infusion in the rat restinosis model resulted in 60% reduction of neointima formation, suggesting its therapeutic potential in restinosis (Tremblay, et al., 2002, MCB, 230:31-47).

Targeted disruption of the murine genes for CNP or cGMP-dependent protein kinase II (PKG II) resulted in severe Dwarfism as a result of impaired endochondral ossification, demonstrating that the CNP/ANP-B system has an essential role in the local stimulation of growth plate chondrocyte proliferation and differentiation, matrix synthesis, and cell hypertrophy through cGMP-mediated activation of PKGII (Chusho et al, 2001, PNAS, 98:4016-4021, Yasoda et al, 2004, Nature Med. 10:80-86). Thus, CNP is a regulatory peptide in the bone, where it activates growth of plate chondrocyte proliferation and differentiation. CNP deletion caused altered endochondral ossification, Dwarfism and early death, while overexpression of CNP in chondrocytes rescued achondroplasia, suggesting that activation of the CNP/ANP-2 system in endochondral bone formation should be considered as a new therapeutic strategy for human achondroplasia (Yasoda et al, 2004, Nature Med, 10:80-86).

The involvement of the CNP and the ANP-B receptor in various reproductive processes in male and female reproductive systems, as well as in embryonic and fetal development was demonstrated (Walther et al, J Endocrinology, 2004, 180:17-22). Both, endocrine function of the testis and the regulation of penile erection are regulated by the CNP/ANP-B axis.

CNP secretion was shown to be suppressed by VEGF, indicating that CNP/ANP-B axis might be involved in regulation of angiogenesis (Doi et al, 1996, Hypertension, 27:811-5).

The NRP-B is expressed in many different tissues, in particular in vascular tissue, bone, high density fibroblasts and in the brain, particularly in the pituitary gland. An extensive analysis of ANP-B deficient mice revealed a complex phenotype with accumulation of white adipose tissue, seizure attacks and infertility (Kuhn, 2004, Basic Res. Cardiol, 99:76-82), suggesting various local physiological roles of ANP-B in tissue remodeling, reproduction and brain function.

Atrial Natriuretic Peptide Receptor B New Variant Structure

Figure 93:
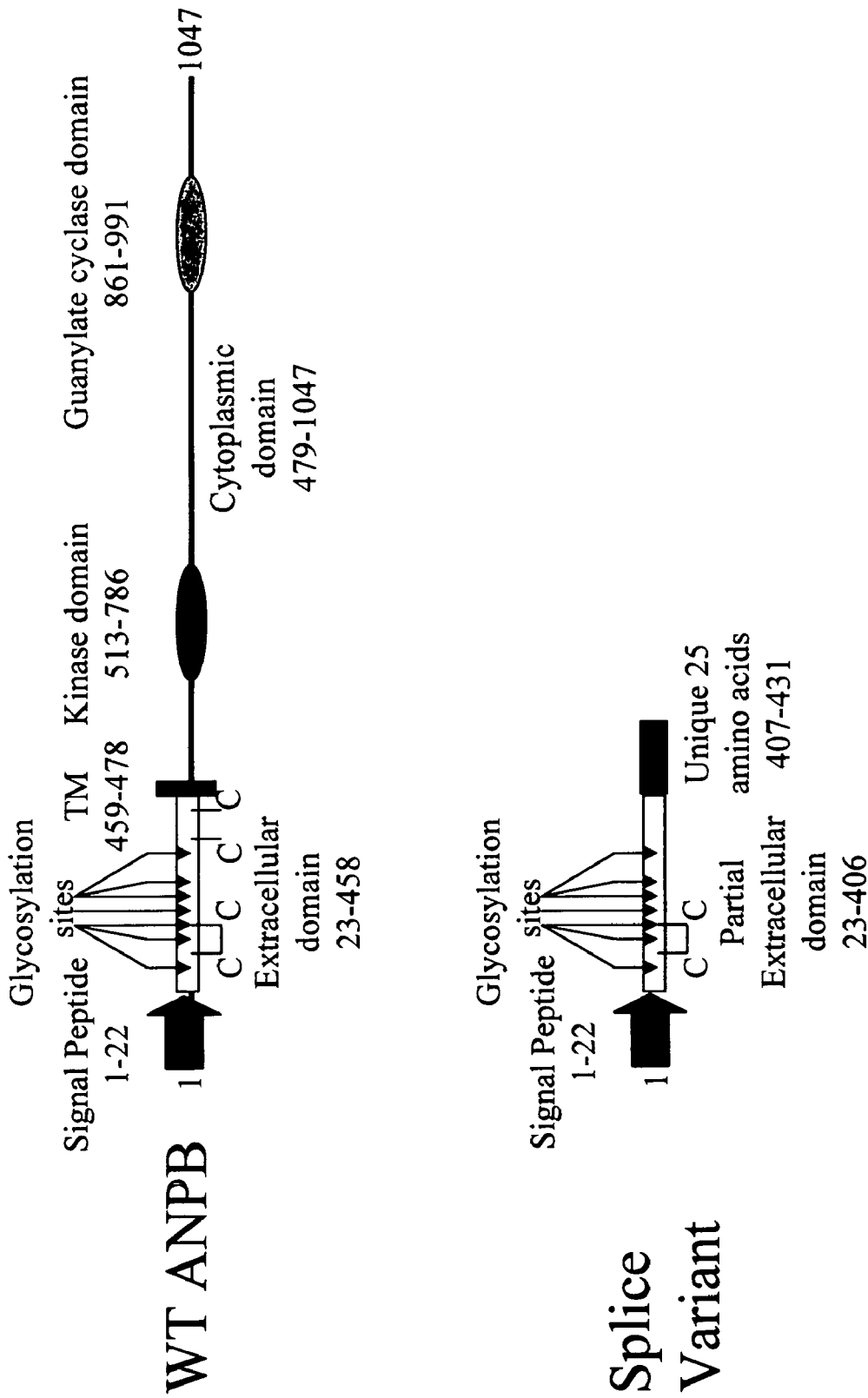
FIG. 93 is a schematic illustration showing the protein domain structure of wild-type Atrial natriuretic peptide receptor B (SwissProt locus: ANPB_HUMAN; SEQ ID NO:153) and the variant of the present invention (SEQ ID NO:122).

Atrial natriuretic peptide receptor B splice variant (HUMGUANCYC_T1—SEQ ID NO:123; HUMGUANCYC_P2—SEQ ID NO:122) of the present invention results from an alternative splicing of the ANPB_HUMAN gene (GenBank Accession No. P20594; SEQ ID NO:153) leading to exon skipping and production of a new truncated atrial natriuretic peptide receptor B protein of 431 amino acids (SEQ ID NO:122), which shares with the wild type atrial natriuretic peptide receptor B the first 406 N-terminal amino acids, containing the signal peptide sequence (amino acids 1-22), partial extracellular ligand binding domain (amino acids 23-406), including all the potential glycosylation sites, but not including the two cysteines potentially involved in the interchain disulfide bonds. The new protein contains 25 C-terminal unique amino acids (LHFQPWQLWLWAQESPSS-CLVFPAS; SEQ ID NO:643; FIG. 92). The new protein does not contain the transmembrane domain of the wild type protein, and therefore is predicted to be secreted. Likewise, the new protein does not contain the cytoplasmic domain of the wild type protein, including the kinase-like and the guanylate cuclase domains (see FIG. 93).

Comparison Report Between HUMGUANCYC_P2 and ANPB_HUMAN (SEQ ID NO:153)

1. An isolated chimeric polypeptide HUMGUANCYC_P2, comprising a first amino acid sequence being at least 90% homologous to MALPSLLLLVAALAGGVRPP-GARNLTLAVVLPEHNLSYAWAWPRVGPAVAL AVEAL-GRALPVDLRFVSSELEGACSEYLAPL-
SAVDLKLYHDPDLLLGPGCVY
PAASVARFASHWRLPLLTAGAVASGF- SAKNDHYRTLVRTGPSAPKLGEFVVT LHGHFNWT-
ARAALLYLDARTDDRPHYFTIEGVFE-
ALQGSNLSVQHQVYARE
PGGPEQATHFIRANGRIVYICGPLEML-
HEILLQAQRENLTNGDYVFFYLDVFG ESLRAGP-
TRATGRPWQDNRTREQAQALREAFQTV-
LVITYREPPNPEYQEFQN
RLLIRAREDFGVELGPSLMNLIAGC-
FYDGILLYAEVLNETIQEGGTREDGLRIV EKMQGR-
RYHGVTGLVVMDKNNDRETDFVL-
WAMGDLDSGDFQ corresponding to amino acids 1-406 of ANPB_HUMAN, which also corresponds to amino acids 1-406 of HUMGUANCYC_P2, and a second amino acid sequence being at least 70%, optionally at least 80%, preferably at least 85%, more preferably at least 90% and most preferably at least 95% homologous to a polypeptide having the sequence LHFQPWQLWLWAQESPSSCLVFPAS corresponding to amino acids 407-431 of HUMGUANCYC_P2, wherein said first amino acid sequence and second amino acid sequence are contiguous and in a sequential order.

2. An isolated polypeptide for a tail of HUMGUANCYC_P2, comprising a polypeptide being at least 70%, optionally at least about 80%, preferably at least about 85%, more preferably at least about 90% and most preferably at least about 95% homologous to the sequence LHFQPWQL-WLWAQESPSSCLVFPAS in HUMGUANCYC_P2.

The new secreted splice variant of atrial natriuretic peptide receptor B is predicted to have an antagonistic mode of action. The atrial natriuretic peptide receptor B splice variant of the present invention has various potential therapeutic and diagnostic implications. It can be used as a negative modulator of the CNP signaling pathway, and hence serve as a potential therapeutic agent in pathological conditions where blocking or reducing the CNP signaling is required, for example, as an anti-angiogenic agent for treatment of solid tumors.

Thus, the present inventors have uncovered a therapeutic agent, a polypeptide homologous to SEQ ID NO:122 and/or an expressible polynucleotide homologous to SEQ ID NO:123 and/or a peptide homologous to SEQ ID NO:643 which can be used to treat cancer (e.g., solid tumor).

It will be appreciated that such an agent can be administered or provided to an individual in need thereof per se or as part of a pharmaceutical composition with a pharmaceutical acceptable carrier (e.g., PEG and liposomes).

While further reducing the present invention to practice, since CNP is mostly expressed in the central nervous system, vascular endothelium, major endocrine glands (e.g., hypothalamus and anterior pituitary), the new atrial natriuretic peptide receptor B variant of the present invention (HUMGUANCYC_P2—SEQ ID NO:122), the polynucleotide encoding same (HUMGUANCYC_T1—SEQ ID NO:123) and/or the peptide derived from the HUMGUANCYC_P2 variant SEQ ID NO:643) can be used as a diagnostic marker for proliferation or de-differentiation of such tissues, as well as for the tissue related tumors. Diagnosis according to this aspect of the present invention is effected using immunological assays [e.g., Western Blot, immunohistochemistry, FACS analysis, radio immuno assay (RIA), immunofluorescence, and the like using an antibody directed against the atrial natriuretic peptide receptor B variant (HUMGUANCYC_P2—SEQ ID NO:122)], nucleic acid techniques (NAT) such as RT-PCR, Northern Blot, in situ hybridization, in situ RT-PCR.

Example 36

Splice Variant of Somatotropin Precursor

Background

The somatotropin precursor (Growth hormone; GH; CSHL1; GH1; GH-N; Pituitary growth hormone; Growth hormone 1; GenBank Accession No. P01241; SOMA_HUMAN) is an extracellular protein which gives rise to growth hormone. Growth hormone involves in various activities including the stimulation of the liver to secrete IGF-I, stimulation of myoblasts to differentiate and proliferate, as well its effect on amino acid uptake and protein synthesis in muscle and other tissues.

Structurally, the somatotropin precursor can be as a monomer, or form dimers, trimers, tetramers and pentamers via disulfide-linkage (at positions 79 and 191 of GenBank Accession No. P01241) or other non-covalent association. It can form a complex with GHBP or the α2-macroglobulin complex.

Growth hormone deficiency results in idiopathic short stature (ISS) and missense mutations were identified in Kowarski syndrome (Takahashi Y and Chihara K., 1998; Int. J. Mol. Med. 2: 287-291). Thus a substitution of R→C at position 103 resulted in loss of activity and Kowarski syndrome phenotype.

The somatotropin precursor is overexpressed in central nervous system (e.g., brain) and other tissues such as the myocardial tissue, and can be used as a marker for proliferation of this tissue or as a marker for pathological de-differentiation of this tissue or tissue damage.

Clinical Applications

Growth hormone is involved in the pathogenesis of various disease, disorders and conditions such as acromegaly, burns, cachexia, Type II diabetes, lipodystrophy, obesity, osteoporosis, female infertility, sex-chromosome abnormality, Turner's syndrome, short-bowel syndrome, uraemia, various cancers (e.g., brain, breast, pancreatic, prostate), diarrhea, muscular atrophy, ulcer, and venostasis, and has been implicated in the treatment of dwarfism, growth hormone deficiency, bone regeneration, and wound healing.

Splice Variant HSGROW1_T10 (SEQ ID NO: 275) Encodes a New Secreted Form of the Somatotropin Precursor, HSGROW1_P11 (SEQ ID NO: 276)

The present inventors have uncovered a new somatotropin precursor variant [HSGROW1_T10—SEQ ID NO:275; HSGROW1_P11—SEQ ID NO:2761. The protein coordinates on the transcript start from nucleotide 80 and end at nucleotide 523 as set forth in SEQ ID NO: 275 (HSGROW1_T10 transcript).

Alignment of the new somatotropin precursor variant (HSGROW1_P11—SEQ ID NO:276) with the WT protein (GenBank Accession No. P01241; SEQ ID NO:640) revealed that the new variant includes the first 57 amino acids as of the WT protein (GenBank Accession No. P01241), is missing amino acids 58-127 of the WT protein (IPR001400, Somatotropin hormone), and includes amino acids 128-217 of the WT (FIG. 120]. Thus, the new variant uncovered by the present invention is expected to be a growth hormone antagonist, which competes and interferes with the endogenous growth hormone.

Comparison Report Between HSGROW1_µl and SOMA_HUMAN (SEQ ID NO:640)

1. An isolated chimeric polypeptide HSGROW1_P11, comprising a first amino acid sequence being at least 90% homologous to MATGSRTSLLLAFGLLCLPWLQEGSAF-PTIPLSRLFDNAMLRAHRLHQLAFDT YQEF corresponding to amino acids 1-57 of SOMA_HUMAN, which also corresponds to amino acids 1-57 of HSGROW1_P11, and a second amino acid sequence being at least 90% homologous to LVYGASDSNVYDLLKDLEE-GIQTLMGRLEDGSPRTGQIFKQTYSKFDTNSHN DDALLKNYGLLYCFRKDMDKVETFL-RIVQCRSVEGSCGF corresponding to amino acids 127-217 of SOMA_HUMAN, which also corresponds to amino acids 58-148 of HSGROW1_P11, wherein said first amino acid sequence and second amino acid sequence are contiguous and in a sequential order.

2. An isolated chimeric polypeptide for an edge portion of HSGROW1_P11, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise FL, having a structure as follows: a sequence starting from any of amino acid numbers 57-x to 57; and ending at any of amino acid numbers 58+((n−2)−x), in which x varies from 0 to n−2.

Thus, the present inventors have uncovered a therapeutic agent, a polypeptide homologous to SEQ ID NO:276 and/or an expressible polynucleotide homologous to SEQ ID NO:275 which can be used to treat acromegaly, anorecsis, GI inflammatory/bowel disorders, osteoporosis treatment and/or can be used as an alimentary/Metabolic, anabolic, antiobesity, anticancer, antidiabetic, fertility enhancer, hypolipaemic/antiatherosclerosis, musculoskeletal, ophthalmological, reproductive/gonadal, somatostatin, symptomatic antidiabetic, urological, vulnerary, antidiarrheal, haemostatic, peripheral vasodilator agent.

It will be appreciated that such an agent can be administered or provided to an individual in need thereof per se or as part of a pharmaceutical composition with a pharmaceutical acceptable carrier (e.g., PEG and liposomes).

While further reducing the present invention to practice, these results suggest the use of the new growth hormone variant of the present invention (SEQ ID NO:276), the polynucleotide encoding same (SEQ ID NO:275) as a diagnostic marker for brain and/or myocardial tissue proliferation or de-differentiation, as well as brain and myocardial tumors. Diagnosis according to this aspect of the present invention is effected using immunological assays [e.g., Western Blot, immunohistochemistry, FACS analysis, radio immuno assay (RIA), immunofluorescence, and the like using an antibody directed against the new growth hormone variant (SEQ ID NO:276)], or by nucleic acid techniques (NAT) such as RT-PCR, Northern Blot, in situ hybridization, in situ RT-PCR.

Example 37

Splice Variant of Lactogen Precursor

Background

The lactogen precursor (Choriomammotropin; Chorionic somatomammotropin; GenBank Accession No. P01243; CSH_HUMAN, which is also known as PLL_HUMAN; CSH1) is a glycoprotein hormone with both lactogenic and growth-promoting activity. Human chorionic somatomammotropin (HCS) is similar to growth hormone and has effects on maternal carbohydrate, fat, and protein metabolism. As maternal utilization of fatty acids increases, available glucose is reserved for the fetus. HCS has its major effect, in conjunction with prolactin, on development of the mammary gland and is involved in cell-cell signaling, pregnancy and signal transduction. Chorionic somatomammotropin is overexpressed in placenta (e.g., in syncytiotrophoblast cells) and can be used as a marker for proliferation of this tissue or as a marker for pathological de-differentiation of this tissue or tissue damage.

Clinical Applications

HCS can be used in the therapeutics in cases in which abortion is feared or for resolving other pathological situations in pregnancy.

In addition, human placental lactogen (hPL) is expressed (positive IHC) in tumor cells of breast cancer with choriocarcinomatous features (Erhan Y, et al., 2002, Breast J. 8: 244-8), thus suggesting HCS as a diagnostic marker for various chorion—related pathologies such as cancer.

Splice Variant HUMCS2_T2 (SEQ ID NO:277) Encodes a New Secreted Form of the Chorionic Somatomammotropin, HUMCS2_P3 (SEQ ID NO:278)

The present inventors have uncovered a new chorionic somatomammotropin variant [HUMCS2_T2—SEQ ID NO:277; HUMCS2_P3—SEQ ID NO:278]. The protein coordinates on the transcript start from nucleotide 139 and end at nucleotide 906 as set forth in SEQ ID NO: 277 (HUMCS2_T2 transcript).

Alignment of the new chorionic somatomammotropin variant (HUMCS2_P3-SEQ ID NO:278) with the WT protein (GenBank Accession No. P01243; SEQ ID NO:330) revealed that the new variant includes the first 152 amino acids as of the WT protein (GenBank Accession No. P01243) followed by a unique 104 amino acid sequence [VRVAPGVTNPGTPLAS-RAGGEKYCCPLFSSKALTQENSPYSSFRLVNP PGLSL-HPEGEGGKWINERGREQCPSAWPLLLFL-HFAEAGRRQPPDWADPQ ADLQQV (SEQ ID NO:331), FIG. 121]. The new variant uncovered by the present invention lacks the Somatotropin hormone domain (IPR001400) of the WT protein, and three of the four potential sites for disulfide bonds (amino acids 191, 208 and 215) and is therefore a potential antagonist of chorionic somatomammotropin.

Comparison Report Between HUMCS2_P3 (SEQ ID NO:278) and CSH_HUMAN (SEQ ID NO:330)

1. An isolated chimeric polypeptide HUMCS2_P3 (SEQ ID NO:278), comprising a first amino acid sequence being at least 90% homologous to MAPGSRTSLLLAFALLCLP-WLQEAGAVQTVPLSRLFDHAMLQAHRAHQLAID TYQEFEETYIPKDQKYSFLHDSQTS-FCFSDSIPTPSNMEETQQKSNLELLRISLL LIESWLEPVRFLRSMFANNLVYDTSDSD-DYHLLKDLEEGIQTLMG corresponding to amino acids 1-152 of CSH_HUMAN, which also corresponds to amino acids 1-152 of HUMCS2_P3 (SEQ ID NO:278), and a second amino acid sequence being at least 70%, optionally at least 80%, preferably at least 85%, more preferably at least 90% and most preferably at least 95% homologous to a polypeptide having the sequence VRVAPGVTNPGTPLAS-RAGGEKYCCPLFSSKALTQENSPYSSFRLVNPPGLSL HPEGEGGKWINERGREQCPSAWPLLLFL-HFAEAGRRQPPDWADPQADLQQV (SEQ ID NO:331) corresponding to amino acids 153-256 of HUMCS2_P3 (SEQ ID NO:278), wherein said first amino acid sequence and second amino acid sequence are contiguous and in a sequential order.

2. An isolated polypeptide for a tail of HUMCS2_P3 (SEQ ID NO:278), comprising a polypeptide being at least 70%, optionally at least about 80%, preferably at least about 85%, more preferably at least about 90% and most preferably at least about 95% homologous to the sequence VRVAPGVT-NPGTPLASRAGGEKYCCPLF-SSKALTQENSPYSSFRLVNPPGLSL HPEGEGGKWIN- ERGREQCPSAWPLLLFLHFAEAGRRQPPDWADPQAD-LQQV (SEQ ID NO:331) in HUMCS2_P3 (SEQ ID NO:278).

Splice Variant HUMCS2_T13 (SEQ ID NO:279) Encodes a New Secreted Form of the Chorionic Somatomammotropin, HUMCS2_P9 (SEQ ID NO:280)

The present inventors have uncovered a new chorionic somatomammotropin variant [HUMCS2_T13—SEQ ID NO:279; HUMCS2_P9—SEQ ID NO:280]. The protein coordinates on the transcript start from nucleotide 139 and end at nucleotide 741 as set forth in SEQ ID NO:279 (HUMCS2_T13 transcript).

Alignment of the new chorionic somatomammotropin variant (HUMCS2_P9-SEQ ID NO:280) with the WT protein (GenBank Accession No. P01243; SEQ ID NO:330) revealed that the new variant includes the first 152 amino acids as of the WT protein (GenBank Accession No. P01243) followed by a unique 49 amino acid sequence [VRVAPGVTNPGTPLAS-RAGGEKYCCPLFSKAGRRQPPDWADPQADLQQV (SEQ ID NO:641), FIG. 122]. The new variant uncovered by the present invention lacks the Somatotropin hormone domain (IPR001400) of the WT protein, and three of the four potential sites for disulfide bonds (amino acids 191, 208 and 215) and is therefore a potential antagonist of chorionic somatomammotropin.

Comparison Report Between HUMCS2_P9 and CSH_HUMAN (GenBank Accession No. P01243)

1. An isolated chimeric polypeptide HUMCS2_P9 (SEQ ID NO:280), comprising a first amino acid sequence being at least 90% homologous to MAPGSRTSLLLAFALLCLP-WLQEAGAVQTVPLSRLFDHAMLQAHRAHQLAID TYQEFEETYIPKDQKYSFLHDSQTS-FCFSDSIPTPSNMEETQQKSNLELLRISLL LIESWLEPVRFLRSMFANNLVYDTSDSD-DYHLLKDLEEGIQTLMG corresponding to amino acids 1-152 of CSH_HUMAN (GenBank Accession No. P01243; SEQ ID NO:330), which also corresponds to amino acids 1-152 of HUMCS2_P9 (SEQ ID NO:280), and a second amino acid sequence being at least 70%, optionally at least 80%, preferably at least 85%, more preferably at least 90% and most preferably at least 95% homologous to a polypeptide having the sequence VRVAPGVTNPGTPLAS-RAGGEKYCCPLFSKAGRRQPPDWADPQADLQQV (SEQ ID NO:641) corresponding to amino acids 153-201 of HUMCS2_P9 (SEQ ID NO:280), wherein said first amino acid sequence and second amino acid sequence are contiguous and in a sequential order.

2. An isolated polypeptide for a tail of HUMCS2_P9 (SEQ ID NO:280), comprising a polypeptide being at least 70%, optionally at least about 80%, preferably at least about 85%, more preferably at least about 90% and most preferably at least about 95% homologous to the sequence VRVAPGVT-NPGTPLASRAGGEKYCCPLFSKAGRRQP-PDWADPQADLQQV (SEQ ID NO:641) in HUMCS2_P9 (SEQ ID NO:280).

Since the HUMCS2_P3 and HUMCS2_P9 variants of the present invention lacks the Somatotropin hormone domain they can compete with the endogenous chorionic somatomammotropin and interfere with its various activities.

Thus, the present inventors have uncovered a therapeutic agent, a polypeptide homologous to SEQ ID NO:278 or 280 and/or an expressible polynucleotide homologous to SEQ ID NO:277 or 279 and/or a peptide homologous to SEQ ID NO:331 or 641 which can be used to treat chorion-related cancer such as breast cancer with choriocarcinomatous features.

It will be appreciated that such an agent can be administered or provided to an individual in need thereof per se or as part of a pharmaceutical composition with a pharmaceutical acceptable carrier (e.g., PEG and liposomes).

While further reducing the present invention to practice, and without being bound to any theory, these results suggest the use of the new Somatotropin variant of the present invention SEQ ID NO:278 or 280), the polynucleotide encoding same (SEQ ID NO:277 or 279) and/or the peptide derived from the new Somatotropin variants (SEQ ID NO:331 or 641) as a diagnostic marker for chorion-related cancer (e.g., breast cancer with choriocarcinomatous features). Diagnosis according to this aspect of the present invention is effected using immunological assays [e.g., Western Blot, immunohistochemistry, FACS analysis, radio immuno assay (RIA), immunofluorescence, and the like using an antibody directed against the HUMCS2_P9 or HUMCS2_P3 variants (SEQ ID NO:278 or 280)], or by nucleic acid techniques (NAT) such as RT-PCR, Northern Blot, in situ hybridization, in situ RT-PCR.

Example 38

Splice Variant of Fibronectin Precursor

Background

Fibronectin (FN; Cold-insoluble globulin; CIG; FN; FN1; GenBank Accession No. P02751; FINC_HUMAN) is a high molecular weight extracellular glycoprotein capable of binding cell surfaces, collagen, fibrin, heparin, DNA, and actin.

Fibronectin is recognized by at least ten cell surface receptors of the integrin family and many cell types in the body can adhere to fibronectin via these receptors. Fibronectins are involved in cell adhesion, cell motility, opsonization, wound, healing, maintenance of cell shape, and acute-phase response. They interact with FBLN1, AMBP and LGALS3BP, form heterodimers or multimers via disulfide bonds.

The extracellular matrix controls cell survival, cell morphology and tissue organization by supporting cell adhesion. Remodeling of the extracellular matrix and cell migration are key processes in the development of properly organized blood vessels, tissues and organs, and have been implicated in pathological processes (Werb, 1997, Cell 91:439-442; Liotta et al., 1991, Cell 64:327-336).

Fibronectin is expressed at the cell surface of many types of differentiated cells and is involved in the attachment of cells to the surrounding extracellular matrix. Soluble plasma fibronectin binds poorly to many cell types, but after deposition onto a suitable substrate, its cell binding avidity is enhanced. The substrates may be collagen in the extracellular matrix or fibrin in peripheral blood. In the extracellular matrix, fibronectin provides signals that control cell shape, migration, proliferation, differentiation, morphogenesis and survival. This makes fibronectin a paradigm adhesive protein, non-reactive in its soluble state, but highly adhesive when insoluble. In the extracellular matrix, adhesive proteins display biologically active cryptic sites that are revealed after structural or conformational alterations. For example, collagen binding may induce a conformational change in fibronectin that disengages the intramolecular interaction of domains I-1/I-2/I-3/I-4/I-5 with III-3 (Pickford A R, et al., EMBO J. 2001, 20: 1519-29). As a result cryptic sites in this gelatin binding domain of fibronectin may be exposed.

More than half of the fibronectin molecule consists of so-called fibronectin type III repeats. Two splice-variants of fibronectin are known. The ED-A splice variant is expressed in some normal tissues and can also be found in the serum and is expression is upregulated in tumor and embryonic tissues. The ED-B splice variant is only expressed in embryonic and tumor tissues and is not detectable in healthy adult tissue.

Clinical Applications

Fibrobectin is been used in the diagnosis of various cancers such as thyroid tumors (Prasad M L, et al., 2005, Mod. Pathol. 18: 48-57), bladder tumor (Mutlu N, et al., 2003, Clin. Chem. Lab, Med. 41: 1069-74), cholangiocarcinoma (Chen C Y, et al., 2003, Hepatogastroenterology, 50: 924-7), malignant ascites (Sood A, et al., 1997. J. Assoc. Physicians. India. 45: 283-5), malignant and benign diseases of the biliary tract (Korner T, et al., Hepatology. 1996 March; 23(3):423-8), as well as in various conditions such as myocardial infarction (Hu B J, et al., 2002, Med. Sci. Law. 42: 195-9), and preterm labour (Grobman W A, et al., 2004, Am. J. Obstet. Gynecol. 191: 235-40).

In addition, fibronectin is accumulated in cases of various injuries such as corneal injury, blood injury and thus can be used as an ophthalmological vulnerary.

Splice Variant HUMFNC_T54 (SEQ ID NO:281) Encodes a New Secreted Form of the Fibronectin, HUMFNC_P54 (SEQ ID NO:282)

The present inventors have uncovered a new fibronectin variant [HUMFNC_T54—SEQ ID NO:281); HUMFNC_P54—SEQ ID NO:2821. The protein coordinates on the transcript start from nucleotide 371 and end at nucleotide 4222 as set forth in SEQ ID NO:281 (HUMFNC_T54 transcript).

Alignment of the new fibronectin variant (HUMFNC_P54—SEQ ID NO: 282) with the WT protein (GenBank Accession No. P02751; SEQ ID NO:644) revealed that the new variant includes the first 1264 amino acids as of the WT protein (GenBank Accession No. P02751) followed by a unique 19 amino acid sequence [GNRKISCYPESDTSNKSGD (SEQ ID NO:645), FIG. 123]. The new variant uncovered by the present invention includes 9 out of 12 fibronectin type I domains (IPR000083), the two fibronectin type II domains, 7 out of 16 fibronectin type III domains (IPR003961), one out of 3 fibrin/heparin binding domains, lacks the connecting strand 3 (CS-3; V region) and the FBLN1 binding domain of the WT protein.

Comparison Report Between HUMFNC_P54 and FINC_HUMAN_V3 (SEQ ID NO:646)

1. An isolated chimeric polypeptide HUMFNC_P54, comprising a first amino acid sequence being at least 90% homologous to MLRGPGPGLLLLAVQCLGTAVPST-GASKSKRQAQQMVQPQSPVAVSQSKPG CYDNGKHYQINQQWERTYLGNALVCT-CYGGSRGFNCESKPEAEETCFDKYT GNTYRVGDTYERPKDSMIWDCTCIGAGR-GRISCTIANRCHEGGQSYKIGDTW RRPHETGGYM-LECVCLGNGKGEWTCKPI-AEKCFDHAAGTSYVVGETWEKPY QGWMMVDCTCLGEGSGRITCTSRN-RCNDQDTRTSYRIGDTWSKKDNRGNLL QCICTGN-GRGEWKCERHTSVQTTSSGSGPFTD-VRAAVYQPQPHPQPPPYGHC VTDSGVVYSVGMQWLKTQGNKQMLCT-CLGNGVSCQETAVTQTYGGNSNGE PCVLPFTYN-GRTFYSCTTEGRQDGHLWC-STTSNYEQDQKYSFCTDHTVLVQT RGGNSNGALCHFPFLYNNHNYTDCTSEG-RRDNMKWCGTTQNYDADQKFGF CPMAAHEEICTT-NEGVMYRIGDQWDKQHDMGHM-MRCTCVGNGRGEWTCI AYSQLRDQCIVDDITYNVNDTFHKRHEE-GHMLNCTCFGQGRGRWKCDPVDQ CQDSETGTFY-QIGDSWEKYVHGVRYQCYCYGRGIGEWH-CQPLQTYPSSSGPV EVFITETPSQPNSHPIQWNAPQPSHIS-KYILRWRPKNSVGRWKEATIPGHLNSY TIKGLKPGV-VYEGQLISIQQYGHQEVTRFDFTTTST-STPVTSNTVTGETTPFSPL VATSESVTEITASSFVVSWVSASDTVSG-FRVEYELSEEGDEPQYLDLPSTATSV NIPDLL-PGRKYIVNVYQISEDGEQSLILSTSQTTAPDAPPD corresponding to amino acids 1-816 of FINC_HUMAN_V3, which also corresponds to amino acids 1-816 of HUMFNC_P54, a bridging amino acid T corresponding to amino acid 817 of HUMFNC_P54, a second amino acid sequence being at least 90% homologous to TVDQVDDTSIVVRWS-RPQAPITGYRIVYSPSVEGSSTELNL-PETANSVTLSDLQ PGVQYNITIYAVEENQESTPV-VIQQETTGTPRSDTVPSPRDLQFVEVTDVKVTI MWTPPESAVTGYRVDVIPVNLPGEHGQR-LPISRNTFAEVTGLSPGVTYYFKVF AVSHGRESKPL-TAQQTTKLDAPTNLQFVNETDSTVLVR-WTPPRAQITGYRLT VGLTRRGQPRQYNVGPSVSKYPLRNLQ-PASEYTVSLVAIKGNQESPKATGVF TTLQPGSSIPPYN-TEVTETTIVITWTPAPRIG-FKLGVRPSQGGEAPREVTSDSGSI VVSGLTPGVEYVYTIQVLRDGQER-DAPIVNKVVTPLSPPTNLHLEANPDTGVL TVSWER-STTPDITGYRITTTPTNGQQGNSLEEV-VHADQSSCTFDNLSPGLEYN VSVYTVKDDKESVPISDTIIP corresponding to amino acids 818-1265 of FINC_HUMAN_V3, which also corresponds to amino acids 818-1265 of HUMFNC_P54, and a third amino acid sequence being at least 70%, optionally at least 80%, preferably at least 85%, more preferably at least 90% and most preferably at least 95% homologous to a polypeptide having the sequence GNRKISCYPESDTSNKSGD corresponding to amino acids 1266-1284 of HUMFNC_P54, wherein said first amino acid sequence, bridging amino acid, second amino acid sequence and third amino acid sequence are contiguous and in a sequential order.

2. An isolated polypeptide for a tail of HUMFNC_P54, comprising a polypeptide being at least 70%, optionally at least about 80%, preferably at least about 85%, more preferably at least about 90% and most preferably at least about 95% homologous to the sequence GNRKISCYPESDTSNKSGD in HUMFNC_P54.

Comparison Report Between HUMFNC_P54 and FINC_HUMAN (SEQ ID NO:644)

1. An isolated chimeric polypeptide HUMFNC_P54, comprising a first amino acid sequence being at least 90% homologous to MLRGPGPGLLLLAVQCLGTAVPST-GASKSKRQAQQMVQPQSPVAVSQSKPG CYDNGKHYQINQQWERTYLGNALVCT-CYGGSRGFNCESKPEAEETCFDKYT GNTYRVGDTYERPKDSMIWDCTCIGAGR-GRISCTIANRCHEGGQSYKIGDTW RRPHETGGYM-LECVCLGNGKGEWTCKPI-AEKCFDHAAGTSYVVGETWEKPY QGWMMVDCTCLGEGSGRITCTSRN-RCNDQDTRTSYRIGDTWSKKDNRGNLL QCICTGN-GRGEWKCERHTSVQTTSSGSGPFTD-VRAAVYQPQPHPQPPPYGHC VTDSGVVYSVGMQWLKTQGNKQMLCT-CLGNGVSCQETAVTQTYGGNSNGE PCVLPFTYN-GRTFYSCTTEGRQDGHLWC-STTSNYEQDQKYSFCTDHTVLVQT corresponding to amino acids 1-410 of FINC_HUMAN, which also corresponds to amino acids 1-410 of HUMFNC_P54, a bridging amino acid R corresponding to amino acid 411 of HUMFNC_P54, a second amino acid sequence being at least 90% homologous to GGNSNGALCHFPFLYNNHNYTDCTSEGRRDNMKWCGTTQNYDADQKFGFC PMAAHEEICTTNEGVMYRIGDQWDKQHDMGHMMRCTCVGNGRGEWTCIA YSQLRDQCIVDDITYNVNDTFHKRHEEGHMLNCTCFGQGRGRWKCDPVDQC QDSETGTFYQIGDSWEKYVHGVRYQCYCYGRGIGEWHCQPLQTYPSSSGPVE VFITETPSQPNSHPIQWNAPQPSHISKYILRWRPKNSVGRWKEATIPGHLNSYT IKGLKPGVVYEGQLISIQQYGHQEVTRFDFTTTSTSTPVTSNTVTGETTPFSPLV ATSESVTEITASSFVVSWVSASDTVSGFRVEYELSEEGDEPQYLDLPSTATSVN IPDLLPGRKYIVNVYQISEDGEQSLILSTSQTTAPDAPPD corresponding to amino acids 412-816 of FINC_HUMAN, which also corresponds to amino acids 412-816 of HUMFNC_P54, a bridging amino acid T corresponding to amino acid 817 of HUMFNC_P54, a third amino acid sequence being at least 90% homologous to TVDQVDDTSIVVRWSRPQAPITGYRIVYSPSVEGSSTELNLPETANSVTLSDLQ PGVQYNITIYAVEENQESTPVVIQQETTGTPRSDTVPSPRDLQFVEVTDVKVTI MWTPPESAVTGYRVDVIPVNLPGEHGQRLPISRNTFAEVTGLSPGVTYYFKVF AVSHGRESKPLTAQQTTKLDAPTNLQFVNETDSTVLVRWTPPRAQITGYRLT VGLTRRGQPRQYNVGPSVSKYPLRNLQPASEYTVSLVAIKGNQESPKATGVF TTLQPGSSIPPYNTEVTETTIVITWTPAPRIGFKLGVRPSQGGEAPREVTSDSGSI VVSGLTPGVEYVYTIQVLRDGQERDAPIVNKVVTPLSPPTNLHLEANPDTGVL TVSWERSTTPDITGYRITTTPTNGQQGNSLEEVVHADQSSCTFDNLSPGLEYN VSVYTVKDDKESVPISDTIIP corresponding to amino acids 818-1265 of FINC_HUMAN, which also corresponds to amino acids 818-1265 of HUMFNC_P54, and a fourth amino acid sequence being at least 70%, optionally at least 80%, preferably at least 85%, more preferably at least 90% and most preferably at least 95% homologous to a polypeptide having the sequence GNRKISCYPESDTSNKSGD corresponding to amino acids 1266-1284 of HUMFNC_P54, wherein said first amino acid sequence, bridging amino acid, second amino acid sequence, bridging amino acid, third amino acid sequence and fourth amino acid sequence are contiguous and in a sequential order.

2. An isolated polypeptide for a tail of HUMFNC_P54, comprising a polypeptide being at least 70%, optionally at least about 80%, preferably at least about 85%, more preferably at least about 90% and most preferably at least about 95% homologous to the sequence GNRKISCYPESDTSNKSGD in HUMFNC_P54.

Thus, the present inventors have uncovered a therapeutic agent, a polypeptide homologous to SEQ ID NO:282 and/or an expressible polynucleotide homologous to SEQ ID NO:281 and/or a peptide homologous to SEQ ID NO:645 which can be used in wound healing, in the treatment of corneal injury, blood injury and as an ophthalmological vulnerary.

It will be appreciated that such an agent can be administered or provided to an individual in need thereof per se or as part of a pharmaceutical composition with a pharmaceutical acceptable carrier (e.g., PEG and liposomes).

While further reducing the present invention to practice, these results suggest the use of the new fibronectin variant of the present invention (HUMFNC_P54—SEQ ID NO:282), the polynucleotide encoding same (HUMFNC_T54—SEQ ID NO:281) and/or the peptide derived from the HUMFNC_P54 variant (GNRKISCYPESDTSNKSGD—SEQ ID NO:645) as a diagnostic marker for thyroid tumors, bladder tumor, cholangiocarcinoma, malignant ascites, malignant and benign diseases of the biliary tract, myocardial infarction, and preterm labour. Diagnosis according to this aspect of the present invention is effected using immunological assays [e.g., Western Blot, immunohistochemistry, FACS analysis, radio immuno assay (RIA), immunofluorescence, and the like using an antibody directed against the fibronectin variant (HUMFNC_P54—SEQ ID NO:2821, or by nucleic acid techniques (NAT) such as RT-PCR, Northern Blot, in situ hybridization, in situ RT-PCR.

Example 39

Splice Variant of Integrin Alpha-8

Background

The integrin family is composed of 15 α and 8 β subunits that form over twenty different αβ heterodimeric combinations on cell surfaces. Integrins recognize extracellular matrix (ECM) proteins and cell surface immunoglobulin family molecules through short peptide sequences. The integrin-mediated adhesion of cells to the ECM leads to bi-directional intracellular signaling events that can regulate cell survival, proliferation and migration. In contrast, inhibition of integrin-ligands interactions suppresses cellular growth or induces apoptotic cell death.

The integrin alpha-8 subunit (ITGA8; GenBank Accession No. P53668; ITA8_HUMAN; SEQ ID NO:327) is a type I membrane protein composed of heavy and light chains linked by a disulfide bond. Integrin α8 associates with integrin β1 to form the α8β1 integrin receptor for fibronectin and cytotactin, vitronectin, tenascin, and osteopontin. Integrin α8 involves in cell-matrix adhesion, cell-cell adhesion. Integrin α8 is expressed in hippocampal dentate hilar neurons, over-expressed in lung injury, smooth muscle cells and can be used as a marker for proliferation of these cell or as a marker for pathological de-differentiation of these cells and tissues. In addition, since integrin α8 is overexpressed in hepatocellular carcinoma (Liu L X, et al., 2002, World J. Gastroenterol. 8: 631-7) it can be used as a marker for such cancer.

Splice Variant M85929_T2 (SEQ ID NO:283) Encodes a New Secreted Form of the Integrin α8, M85929_P3 (SEQ ID NO:284)

The present inventors have uncovered a new integrin α8 variant [M85929_T2—SEQ ID NO:283; M85929_P3—SEQ ID NO:284]. The protein coordinates on the transcript start from nucleotide 388 and end at nucleotide 2292 as set forth in SEQ ID NO:283 (M85929_T2 transcript).

Alignment of the new integrin α8 variant (M85929_P3—SEQ ID NO:284) with the WT protein (GenBank Accession No. P53708; SEQ ID NO:327) revealed that the new variant includes the first 634 amino acids as of the WT protein (GenBank Accession No. M85929_P3) followed by a unique amino acid R [FIG. 124]. The new variant uncovered by the present invention lacks the integrin α8 light chain (IPR000413; amino acids 907-1063 of WT), the transmembrane domain (amino acids 1013-1033 of WT), the cytoplasmic domain (amino acids 1034-1063 of WT), as well as four potential disulfide bond and six potential glycosylation sites and therefore is expected to be a secreted, soluble protein (i.e., extracellular).

Comparison Report Between M85929_P3 (SEQ ID NO:284) and ITA8_HUMAN (SEQ ID NO:327)

1. An isolated chimeric polypeptide M85929_P3 (SEQ ID NO:284), comprising a first amino acid sequence being at least 70%, optionally at least 80%, preferably at least 85%, more preferably at least 90% and most preferably at least 95% homologous to a polypeptide having the sequence MSPGAS-RGPRGSQAPLIAPLCCAAAALGMLLWSPACQA corresponding to amino acids 1-38 of M85929_P3 (SEQ ID NO:284), a second amino acid sequence being at least 90% homologous to FNLDVEKL corresponding to amino acids 1-8 of ITA8_HUMAN (SEQ ID NO:327), which also corresponds to amino acids 39-46 of M85929_P3 (SEQ ID NO:284), a bridging amino acid T corresponding to amino acid 47 of M85929_P3 (SEQ ID NO:284), a third amino acid sequence being at least 90% homologous to VYSGPKGSY-FGYAVDFHIPDARTASVLVGAP-KANTSQPDIVEGGAVYYCPWP AEGSAQCRQIPFDTT-NNRKIRVNGTKEPIEFKSNQWFGATVKAHKGKVVACA PLYHWRTLKPTPEK corresponding to amino acids 10-127 of ITA8_HUMAN (SEQ ID NO:327), which also corresponds to amino acids 48-165 of M85929_P3 (SEQ ID NO:284), a bridging amino acid D corresponding to amino acid 166 of M85929_P3 (SEQ ID NO:284), a fourth amino acid sequence being at least 90% homologous to PVGTCY-VAIQNFSAYAEFSPC corresponding to amino acids 129-149 of ITA8_HUMAN (SEQ ID NO:327), which also corresponds to amino acids 167-187 of M85929_P3 (SEQ ID NO:284), a bridging amino acid R corresponding to amino acid 188 of M85929_P3, a fifth amino acid sequence being at least 90% homologous to NSNADPEGQGYCQAGFSLD-FYKNGDLIVGGPGSFYWQGQVITASVADIIANY SFKDILRKLAGEKQTEVAPASY-DDSYLGYSVAAGEFTGDSQQELVAGIPRGA QNF-GYVSIINS corresponding to amino acids 151-265 of ITA8_HUMAN (SEQ ID NO:327), which also corresponds to amino acids 189-303 of M85929_P3 (SEQ ID NO:284), a bridging amino acid T corresponding to amino acid 304 of M85929_P3, a sixth amino acid sequence being at least 90% homologous to DMTFIQNFTGEQMASYFGYTVVVSD-VNSDGLDDVLVGAPLFMEREFESNPRE VGQIY-LYLQVSSLLFRDPQILTGTETFGRFGSA-MAHLGDLNQDGYNDIAIGVP FAGKDQRGKVLIYNGNKDGLNTKPSQV-LQGVWASHAVPSGFGFTLRGDSDI DKNDYPDLIV-GAFGTGKVAVYRARPVVTVDAQLLLHP-MIINLENKTCQVPDS MTSAACFSLRVCASVTGQSIANTIVL-MAEVQLDSLKQKGAIKRTLFLDNHQA HRVFPL-VIKRQKSHQCQDFIVYLRDETEFRDKL-SPINISLNYSLDESTFKEGLEV KPILNYYRENIVSEQ corresponding to amino acids 267-596 of ITA8_HUMAN (SEQ ID NO:327), which also corresponds to amino acids 305-634 of M85929_P3 (SEQ ID NO:284), a seventh amino acid sequence being at least 70%, optionally at least 80%, preferably at least 85%, more preferably at least 90% and most preferably at least 95% homologous to a polypeptide having the sequence R corresponding to amino acids 635-635 of M85929_P3 (SEQ ID NO:284), wherein said first amino acid sequence, second amino acid sequence, bridging amino acid, third amino acid sequence, bridging amino acid, fourth amino acid sequence, bridging amino acid, fifth amino acid sequence, bridging amino acid, sixth amino acid sequence and seventh amino acid sequence are contiguous and in a sequential order.

2. An isolated polypeptide for a head of M85929_P3 (SEQ ID NO:284), comprising a polypeptide being at least 70%, optionally at least about 80%, preferably at least about 85%, more preferably at least about 90% and most preferably at least about 95% homologous to the sequence MSPGASRG-PRGSQAPLIAPLCCAAAALGMLLWSPACQA of M85929_P3 (SEQ ID NO:284).

Since the integrin α8 variant of the present invention lacks the transmembrane domain as well as the integrin α8 light chain it can compete with the endogenous integrin α8 on associating with the integrin β subunits and serve as an antagonist of the integrin α8β1 receptor and interfere with its various activities.

Thus, the present inventors have uncovered a therapeutic agent, a polypeptide homologous to SEQ ID NO:284 and/or an expressible polynucleotide homologous to SEQ ID NO:283 which can be used to prevent the association of endogenous integrin α8 with the integrin β1 subunit and/or with an α8 ligand and thus prevent integrin α8β1 activation and treat integrin α8β1-related disease, disorder or condition such as cancer (e.g., hepatocellular carcinoma).

It will be appreciated that such an agent can be administered or provided to an individual in need thereof per se or as part of a pharmaceutical composition with a pharmaceutical acceptable carrier (e.g., PEG and liposomes).

Example 40

Splice Variant of Thrombopoietin

Background

Thrombopoietin (TPO, also known as c-Mpl ligand) is a hematopoietic growth factor that mediates megakaryocyte progenitor proliferation and differentiation, and increased platelets production. It is produced constitutively, mainly in the liver with trace amounts being produced in the kidney, it circulates in the bloodstream, and delivered to the bone marrow, where it stimulates the early development of multiple hematopoietic lineages and megakaryocytopoiesis. TPO has multi lineage effects in hematopoiesis, and in addition for stimulating megakaryocytes it also acts in synergy with other cytokines to enhance proliferation and survival of committed erythroid progenitors and primitive hematopoietic stem cells. Elevated TPO levels occur in thrombocytopenia and leads to an increase in megakaryocyte number, size, and ploidy and will result in increased production of platelets. It has been suggested that a feedback mechanism can sense a decrease in platelet mass and cause an increase in TPO activity. c-Mpl, the TPO-receptor, is an oncogene that belongs to the hematopoitic receptor family. TPO activity is probably regulated by the binding and metabolism by c-Mpl-expressing platelets.

The TPO protein is divided into two domains: an amino terminal half (153 amino acids, not including the signal peptide which consists of 21 amino acids) with homology to erythropoietin (epo-like domain) and a unique C-terminal domain (of 182 amino acids) containing multiple potential N-linked glycosylation sites. The epo-like domain alone is sufficient for activation of c-Mpl. TPO-2, a naturally occurring alternative splice variant that result from an alternative acceptor site in exon 6 and in the concomitant deletion of amino acids 133-136 (numbers include the signal peptide) which reside within the epo-like domain, is inactive (Gurney, A. L., W. J. Kuang, M. H. Xie, B. E. Malloy, D. L. Eaton, and F. J. de Sauvage. 1995. Genomic structure, chromosomal localization, and conserved alternative splice forms of thrombopoietin. Blood 85:981.).

Clinical Applications

An obvious clinical indication for the use of TPO is for treatment of thrombocytopenias, especially those resulting from chemo- and irradiation therapy. Non-cancer related thrombocytopenia where TPO might have efficacy is Immunologic thrombocytopenia (ITP) in which premature removal of platelets from the circulation occurs, and HIV-related thrombocitopenia (Lok, S., and D. C. Foster. 1994. The structure, biology and potential therapeutic applications of recombinant thrombopoietin. Stem Cells 12:586.).

As TPO is highly involved in platelet aggregation (Oda, A., Y. Miyakawa, B. J. Druker, K. Ozaki, K. Yabusaki, Y. Shirasawa, M. Handa, T. Kato, H. Miyazaki, A. Shimosaka, and Y. Ikeda. 1996. Thrombopoietin primes human platelet aggregation induced by shear stress and by multiple agonists. Blood 87:4664.), TPO antagonists might be useful in preventing coagulation. In addition TPO antagonist might be useful for treatment of essential thrombocytopenia (ET)—a chronic myeloproliferative syndrome caused by sustained proliferation of megakaryocytes which result in elevated levels of circulating platelets, thrombotic or hemorrhagic episodes and occasional leukaemic transformation.

Splice Variant Structure

Figure 87:
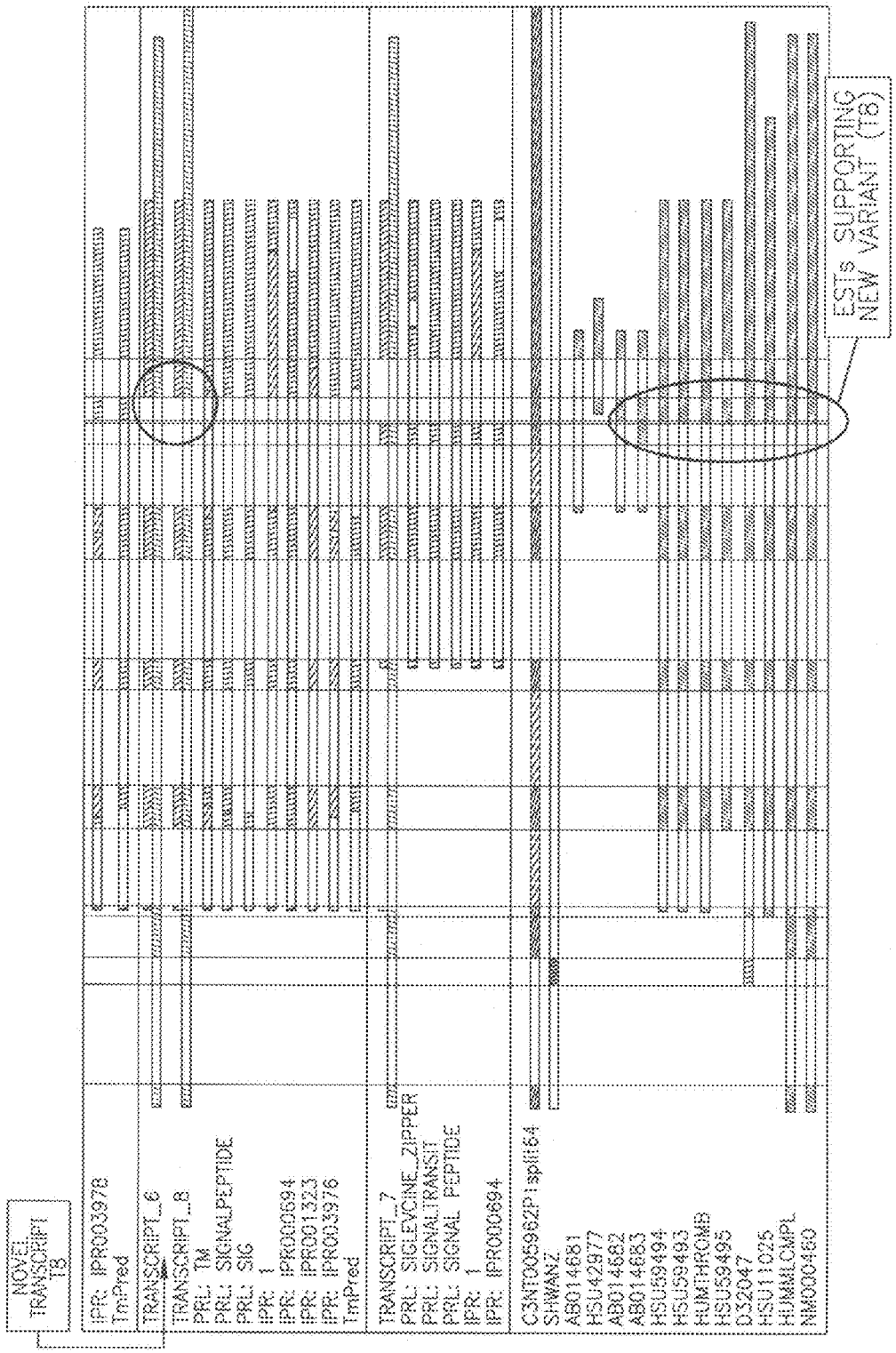
FIG. 87 is a schematic illustration depicting the graphical viewer scheme presenting the new variant of Thrombopoietin transcript_T8 as compared to the wild type mRNA. The ESTs supporting the new variant are indicated. Transcript indicated as "0" represents known mRNA. The pattern code is as in FIG. 2.
Figure 89:
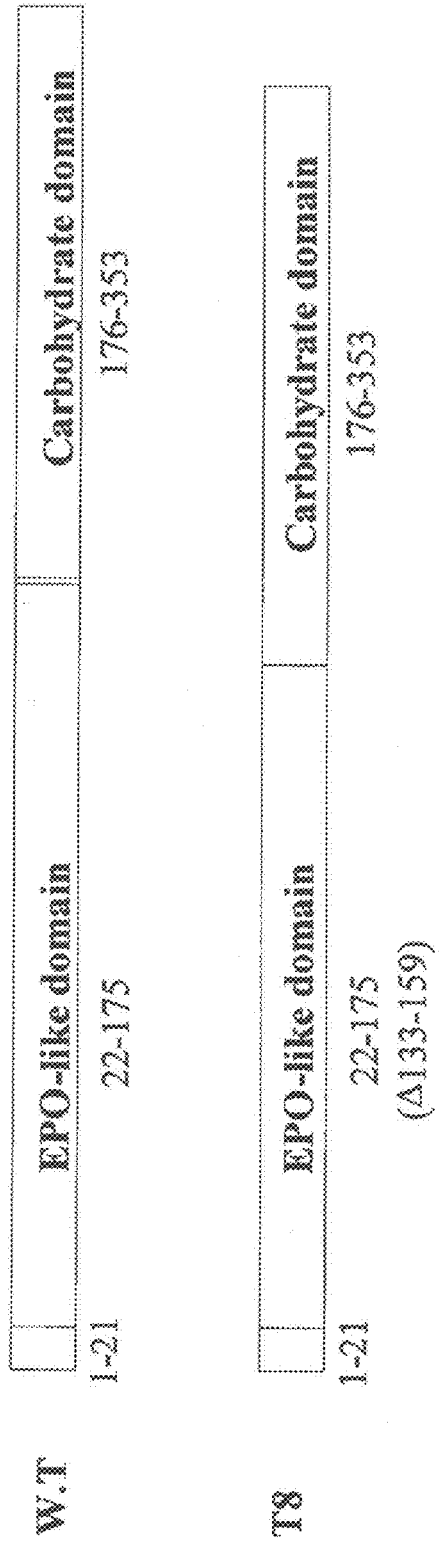
FIG. 89 is a schematic illustration showing the protein domain structure of wild-type Thrombopoietin (SwissProt locus: TPO_HUMAN; SEQ ID NO:151) and the variant of the present invention (SEQ ID NO:118).

The present inventors uncovered two novel splice variant of Thrombopoietin. The new splice variant T8 [HSU11025_T8—SEQ ID NO:119 (FIG. 86*a*); HSU11025_P6—SEQ ID NO:118 (FIG. 86*b*)] results from alternative splicing of the thrombopoietin gene, thus introducing an alternative splice acceptor site in exon 6, causing a deletion of amino acids 133-159 of the WT protein (TPO_HUMAN; SEQ ID NO:151). The variant protein thus created is a 327 amino acids long protein (SEQ ID NO:118), which contains the N-terminal epo-like domain with 26 amino acids deletion, and a complete carbohydrate domain (FIGS. 87-89).

Comparison Report Between HSU11025_P6 (SEQ ID NO:118) and TPO_HUMAN (SEQ ID NO:151)

1. An isolated chimeric polypeptide HSU11025_P6 (SEQ ID NO:118), comprising a first amino acid sequence being at least 90% homologous to MELTELLLVVMLLLTARLTLSSPAPPACDLRVLSKLLRDSHVLHSRLSQCPEV HPLPTPVLLPAVDFSLGEWKTQMEET-KAQDILGAVTLLLEGVMAARGQLGPT CLSSLLGQLS-GQVRLLLGALQSLLGTQ corresponding to amino acids 1-132 of TPO_HUMAN (SEQ ID NO:151), which also corresponds to amino acids 1-132 of HSU11025_P6 (SEQ ID NO:118), and a second amino acid sequence being at least % homologous to VRFLMLVGGSTLCVRRAPPT-TAVPSRTSLVLTLNELPNRTSGLLETNFTASAR TTGS-GLLKWQQGFRAKIPGLLNQTSRSLD-QIPGYLNRIHELLNGTRGLFPGPSR RTLGAPDISSGTSDTGSLPPN-LQPGYSPSPTHPPTGQYTLFPLPPTLPTPVVQLH PLL-PDPSAPTPTPTSPLLNTSYTHSQNLSQEG corresponding to amino acids 160-353 of TPO_HUMAN (SEQ ID NO:151), which also corresponds to amino acids 133-326 of HSU11025_P6 (SEQ ID NO:118), wherein said first amino acid sequence and second amino acid sequence are contiguous and in a sequential order.

2. An isolated chimeric polypeptide for an edge portion of HSU11025_P6 (SEQ ID NO:118), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QV, having a structure as follows: a sequence starting from any of amino acid numbers 132-x to 132; and ending at any of amino acid numbers 133+((n−2)−x), in which x varies from 0 to n−2.

Therapeutic Applications for the Thrombopoietin Splice Variant

The epo-like domain is sufficient and necessary for TPO activity, thus, as T8 has an impaired epo-like domain, it is predicted to be inactive. In addition, mutating amino acids 153, 154 or 159 resulted in reduced proliferation activity, and their deletion in T8 will probably result in a pronounced reduction of activity (Jagerschmidt, A., V. Fleury, M. Anger-Leroy, C. Thomas, M. Agnel, and P. O'Brien D. 1998. Human thrombopoietin structure-function relationships: identification of functionally important residues. Biochem J 333 (Pt 3):729.). However, it might serve as an antagonist and prevent TPO-induced coagulation.

The variants according to the present invention preferably serve as TPO antagonists and/or partial agonists. They may optionally be used to treat any type of TPO-mediated and/or promoted disease or disorder, including but not limited to, preventing coagulation (for situations in which coagulation is excessive and/or undesirable) or treatment of essential thrombocytopenia (ET), and may optionally be useful for treatment of blood disorders in which blockage or reduction of TPO activity is desirable.

Example 41

Intracellular Adhesion Molecule 2

Background

Intracellular adhesion molecule 2 (ICAM-2, CD102 antigen) is a member of the immunoglobulin superfamily, encompassing two immunoglobulin domains, was originally described as a counterreceptor for the leukocyte integrin leukocyte function antigen-1 (LFA-1). ICAM-2 play a role in lymphocyte recirculation by blocking LFA-1 dependent cell adhesion. It mediates adhesive interactions important for antigen specific immune response, NK-cell mediated clearance, lymphocyte recirculation and other cellular interactions important for immune response and surveillance.

ICAM-2 expression is restricted to endothelial cells and lymphocytes. The surface expression on lymphocytes is up-regulated on activation from low basal levels and, importantly, many malignancies derived from both T and B lymphocytes are ICAM-2 positive. Recent studies have established that mannose-rich carbohydrate structures attached to ICAM-2 interact with the Dendritic Cell (DC)-specific lectin DC-SIGN (CD209), playing, therefore, a potentially important role both in DC-T-cell interactions and DC trafficking through endothelial bathers. DC-SIGN was proposed to be used by viral and bacterial pathogens, including HCV, HIV, Ebola virus, CMV, and *Mycobacterium tuberculosis*, to facilitate infection. ICAM-2 was shown to ignite a signaling pathway that inhibits programmed cell death (Murillo, et al, 2003, Clin Cancer Res., 9:5454-5464).

The first NH2-terminal immunoglobulin domain of ICAM-2 is important for binding to LFA-1 (CD11a/CD18) and Mac-1 (CD11b/CD18) (Kotovuori et al, 1999, J Immunol, 162:6613-6620). Synthetic 22 amino acid peptide (P1), derived from residues 21-42 of the ICAM-2 protein (numbering without the signal peptide), corresponding to a sequence from the first Ig domain, was shown to be able to bind CD11a/CD18 and CD11b/CD18 and stimulate aggregation of various leukocytes and stimulate the migration and cytotoxicity of NK cells. P1 was further shown to stimulate the adhesion of T-cell lymphocytes to ICAM-1, 2, and 3, and induced increased integrin affinity for ICAMs (Kotovuori et al, 1999, J Immunol, 162:6613-6620; Li, et al 1995, JCB, 129:1143-1153; Li et al, 1993, JBC, 268:21474-21477). The finding that P1 stimulates the binding of leukocytes to fibrinogen raises the intriguing possibility that ICAM-2, which is constitutively expressed on most endothelia have an important role in leukocyte binding during physiological conditions. On the other hand, the capacity of the P1 peptide to inhibit the adhesion of ICAM-2 containing nonleukocytic endothelial cells to CD11a/CD18 was demonstrated as well, supporting the contribution of this peptide to the adhesive interaction itself. P1 also inhibited the binding of B-lymphoblastoid cells to endothelial cells (Li, et al 1995, JCB, 129:1143-1153; Li et al, 1993, JBC, 268:17513-16518).

Soluble ICAM-2Fc proteins, containing either a part of or the entire extracellular region of the molecule, exhibited costimulatory effects of ICAM-2 and were able to induce T lymphocyte adhesion to purified ICAMs (Damle et al, 1992, J Immunol., 148:665-671).

Mutagenesis studies of ICAMSs have shown that four conserved residues are important for adhesive interactions with LFA-1: Glu-37 is the most critical for integrin binding, while Tyr-54, Gln-30 and Gln-75 are also important (Casaanovas, et al, 1997, Nature, 387:312-315).

Inhibition of CD11a, LFA-1, or its ligand have been shown to be a useful target for therapy of several inflammatory situations associated with accumulation of leukocytes leading to clot formation or cytotoxicity. mAbs to CD11a, ICAM-1, and CD18 were comparably effective in a rabbit model of myocardial reperfusion injury and reduced infarct size by 40-50%, but only if administered well before reperfusion. Reducing cytotoxic T cell activity by mAbs to CD11a/CD18, in combination with standard immunosuppressive therapy, improve the survival of bone marrow transplants in children but not in adults. In a mouse model, anti CD11a mAbs increased the survival of allogenic tumor grafts. LFA-1 might also be involved in cancer metastasis as its expression on hematological tumor cells have been shown to alter metastatic capacity and growth (Mazzone and Richevuti, 1995).

Binding of immunotherapeutic mAbs to ICAM-2 enhance its adhesiveness to DC-SIGN, and promotes the survival of activated T lymphocytes that recognize tumor antigens (Murillo, et al, 2003, Clin Cancer Res., 9:5454-5464).

Intracellular Adhesion Molecule-2 Novel Splice Variants HSICAM2_T12 (SEQ ID NO:339) Encodes a New Secreted Form of ICAM-2, HSICAM2_P8 (SEQ ID NO:338)

Intracellular Adhesion Molecule-2 splice variants of the present invention results from an alternative splicing of the ICAM-2 (GenBank Accession No. P13598; ICA2_HUMAN; SEQ ID NO:154). The alternatively spliced new variant HSICAM2-T12 (SEQ ID NO:339) results due to exon 2 extension incorporating into the new mRNA part of the intronic sequence from the intron located originally between exon 2 and 3 in the known wild type sequence, and production of a new truncated Intracellular Adhesion Molecule-2 protein, encoding 149 amino acids (HSICAM2_P8—SEQ ID NO:338), which shares with the wild type Intracellular Adhesion Molecule-2 the first 109 N-terminal amino acids, containing the signal peptide sequence (amino acids 1-21), partial extracellular ligand binding domain (amino acids 22-109 of the ICA2_HUMAN amino acid sequence), including the first Ig-like domain, three out of six potential glycosylation sites, two of the three cysteines, potentially involved in the disulfide bonds. The new protein does not contain the second Ig-like domain, however it retains all four amino acid residues, known to be crucial for integrin binding, Glu-37, Tyr-54, Gln-30 and Gln-75 (numbering on the mature protein). The new protein contains 40 C-terminal unique amino acids (REWLCCGALLSPGTEAVSTECTQSPSV-PAPGHCHRGALPP—SEQ ID NO:340). The new protein does not contain the transmembrane domain of the wild type protein, and therefore is predicted to be secreted protein. The new protein does not contain the cytoplasmic domain of the wild type protein. The sequence alignment between the novel Intracellular Adhesion Molecule-2 splice variant HSICAM2-P8 (SEQ ID NO:338) of the present invention and the known Intracellular Adhesion Molecule-2 amino acid sequence is presented in FIG. 94a. The schematic drawing of the new variant as compared to the wild type protein is presented in FIG. 95.

Comparison Report Between HSICAM2_P8 (SEQ ID NO:338) and ICA2_HUMAN ((SEQ ID NO:154)

1. An isolated chimeric polypeptide HSICAM2_P8, comprising a first amino acid sequence being at least 90% homologous to MSSFGYRTLTVALFTLICCPGSDEKVFE-VHVRPKKLAVEPKGSLEVNCSTTCN QPEVGGLETSL corresponding to amino acids 1-64 of ICA2_HUMAN, which also corresponds to amino acids 1-64 of HSICAM2_P8, a bridging amino acid D corresponding to amino acid 65 of HSICAM2_P8, a second amino acid sequence being at least 90% homologous to KILLDEQAQWKHYLVSNISHDTV-LQCHFTCSGKQESMNSNVSVY corresponding to amino acids 66-109 of ICA2_HUMAN, which also corresponds to amino acids 66-109 of HSICAM2_P8, and a third amino acid sequence being at least 70%, optionally at least 80%, preferably at least 85%, more preferably at least 90% and most preferably at least 95% homologous to a polypeptide having the sequence REWLCCGALLSPGTEAVSTECTQSPSV-PAPGHCHRGALPP (SEQ ID NO:340) corresponding to amino acids 110-149 of HSICAM2_P8, wherein said first amino acid sequence, bridging amino acid, second amino acid sequence and third amino acid sequence are contiguous and in a sequential order.

2. An isolated polypeptide for a tail of HSICAM2_P8, comprising a polypeptide being at least 70%, optionally at least about 80%, preferably at least about 85%, more preferably at least about 90% and most preferably at least about 95% homologous to the sequence REWLCCGALL-SPGTEAVSTECTQSPSVPAPGHCHRGALPP in HSICAM2_P8.

Comparison Report Between HSICAM2_P8 and ICA2_HUMAN_V1

1. An isolated chimeric polypeptide HSICAM2_P8, comprising a first amino acid sequence being at least 90% homologous to MSSFGYRTLTVALFTLICCPGSDEKVFE-VHVRPKKLAVEPKGSLEVNCSTTCN QPE-VGGLETSLDKILLDEQAQWKHYLVS-NISHDTVLQCHFTCSGKQESMNSN VSVY corresponding to amino acids 1-109 of ICA2_HUMAN_V1, which also corresponds to amino acids 1-109 of HSICAM2_P8, and a second amino acid sequence being at least 70%, optionally at least 80%, preferably at least 85%, more preferably at least 90% and most preferably at least 95% homologous to a polypeptide having the sequence REWL-CCGALLSPGTEAVSTECTQSPSVPAPGHCHRGALPP (SEQ ID NO:340) corresponding to amino acids 110-149 of HSICAM2_P8, wherein said first amino acid sequence and second amino acid sequence are contiguous and in a sequential order.

2. An isolated polypeptide for a tail of HSICAM2_P8, comprising a polypeptide being at least 70%, optionally at least about 80%, preferably at least about 85%, more preferably at least about 90% and most preferably at least about 95% homologous to the sequence REWLCCGALL-SPGTEAVSTECTQSPSVPAPGHCHRGALPP in HSICAM2_P8.

Intracellular Adhesion Molecule-2 Novel Splice Variants HSICAM2_T8 (SEQ ID NO:336) Encodes a New Secreted Form of ICAM-2, New Variant Encoded by HSICAM2_T8 (SEQ ID NO:335)

The alternatively spliced new variant HSICAM2-T8 (transcript—SEQ ID NO:336, protein—SEQ ID NO:335) results from the incorporation of an alternative exon between the original exons 2 and 3, derived from the intronic sequence located originally between exon 2 and 3 in the known wild type sequence, and production of a new truncated Intracellular Adhesion Molecule-2 (SEQ ID NO:335), comprising 164 amino acids, which shares with the wild type Intracellular Adhesion Molecule-2 (ICA2_HUMAN, SEQ ID NO:154) the 109 N-terminal amino acids, containing the signal peptide sequence (amino acids 1-21), partial extracellular ligand binding domain (amino acids 22-109), including the first Ig-like domain, three out of six potential glycosylation sites, two of the three cysteins, potentially involved in the disulfide bonds. The new protein does not contain the second Ig-like domain, however it retains all four amino acid residues, known to be crucial for integrin binding, Glu-37, Tyr-54, Gln-30 and Gln-75 (according to the sequence of the mature protein). The new protein contains 55 C-terminal unique amino acids (LGCTISEPCPCRHLVTGNHH-VCKTTTQSSLHPQLLPSSSLHWSRPGHLLPNRG TP—SEQ ID NO:337). The new protein does not contain the transmembrane domain of the wild type protein, and therefore it is predicted to be secreted. The new protein does not contain the cytoplasmic domain of the wild type protein. The sequence alignment between the novel Intracellular Adhesion Molecule-2 splice variant HSICAM2-P8 (SEQ ID NO:335) of the present invention and the known Intracellular Adhesion Molecule-2 is presented in FIG. 94b. The schematic drawing of the new variant as compared to the wild type protein is presented in FIG. 95.

Clinical Applications of the New Variants

Synthetic 22 amino acid peptide (P1), derived from the first NH2-terminal immunoglobulin domain of the ICAM-2 protein was shown to be able to bind CD11a/CD18 and CD11b/CD18 and stimulate aggregation of various leukocytes as well as stimulate the migration and the cytotoxicity of NK cells. P1 was further shown to stimulate the adhesion of T-cell lymphocytes to ICAM-1, 2, and 3, and induced increased integrin affinity for ICAMs (Kotovuori et al, 1999, J Immunol, 162: 6613-6620; Li, et al 1995, JCB, 129:1143-1153; Li et al, 1993, JBC, 268:21474-21477). Soluble ICAM-2Fc protein was also able to induce T lymphocyte adhesion to purified ICAMs. On the other hand, the P1 peptide inhibits the adhesion of ICAM-2 containing nonleukocytic endothelial cells to CD11a/CD18 and inhibits the binding of B-lymphoblastoid cells to endothelial cells (Li, et al 1995, JCB, 129:1143-1153; Li et al, 1993, JBC, 268:17513-16518). The ICAM-2 new variants [(HSICAM2-P8 (SEQ ID NO:335) and HSICAM2-P12 (SEQ ID NO:338)] of the present invention are therefore predicted to be secreted proteins with agonistic mode of action, binding to the integrin receptors and enhancing aggregation of various leukocytes as well as stimulating the migration and the cytotoxicity of NK cells. The new variants of the present invention are predicted to have antagonistic mode of action on endothelial cells.

The ICAM-2 new variants of the present invention can be used as immunostimulatory therapeutic agents for treatment of pathological conditions where immunostimulation can be of therapeutic benefit, such as for treatment of malignant diseases and infectious diseases. The ICAM-2 new variants of the present invention can be also used for potential therapy of cancer metastasis, based on inhibition of adhesive interaction between cancer cells and endothelial cells.

Thus, the present inventors uncovered a therapeutic agent which can be used to treat malignant diseases, infectious diseases, and cancer metastasis. Such an agent is a polypeptide homologous to the ICAM variants of the present invention (SEQ ID NO:338 or 335), and/or a polynucleotide homologous to SEQ ID NO:339 or 336, and/or a peptide homologous to SEQ ID NO:340 or 337.

It will be appreciated that such an agent can be administered or provided to an individual in need thereof per se or as part of a pharmaceutical composition with a pharmaceutical acceptable carrier (e.g., PEG and liposomes).

Example 42

Description for Cluster HSEGF01

Cluster HSEGF01 features 4 transcript(s) and 48 segment(s) of interest, the names for which are given in Tables 44 and 45, respectively, the sequences themselves are given in SEQ ID NOs: 371-374; 375-422 and 423-426, for transcript; segments and proteins, respectively. The selected protein variants are given in Table 46.

TABLE 44

Transcripts of interest

| Transcript Name | SEQ ID NO |
|---|---|
| HSEGF01_PEA_1_T12 | 371 |
| HSEGF01_PEA_1_T19 | 372 |
| HSEGF01_PEA_1_T22 | 373 |
| HSEGF01_PEA_1_T27 | 374 |

TABLE 45

Segments of interest

| Segment Name | SEQ ID NO |
|---|---|
| HSEGF01_PEA_1_node_1 | 375 |
| HSEGF01_PEA_1_node_12 | 376 |
| HSEGF01_PEA_1_node_15 | 377 |
| HSEGF01_PEA_1_node_17 | 378 |
| HSEGF01_PEA_1_node_18 | 379 |
| HSEGF01_PEA_1_node_25 | 380 |
| HSEGF01_PEA_1_node_26 | 381 |
| HSEGF01_PEA_1_node_29 | 382 |
| HSEGF01_PEA_1_node_30 | 383 |
| HSEGF01_PEA_1_node_37 | 384 |
| HSEGF01_PEA_1_node_51 | 385 |
| HSEGF01_PEA_1_node_53 | 386 |

TABLE 45-continued

Segments of interest

| Segment Name | SEQ ID NO |
|---|---|
| HSEGF01_PEA_1_node_57 | 387 |
| HSEGF01_PEA_1_node_59 | 388 |
| HSEGF01_PEA_1_node_63 | 389 |
| HSEGF01_PEA_1_node_67 | 390 |
| HSEGF01_PEA_1_node_72 | 391 |
| HSEGF01_PEA_1_node_77 | 392 |
| HSEGF01_PEA_1_node_84 | 393 |
| HSEGF01_PEA_1_node_85 | 394 |
| HSEGF01_PEA_1_node_86 | 395 |
| HSEGF01_PEA_1_node_90 | 396 |
| HSEGF01_PEA_1_node_91 | 397 |
| HSEGF01_PEA_1_node_96 | 398 |
| HSEGF01_PEA_1_node_97 | 399 |
| HSEGF01_PEA_1_node_98 | 400 |
| HSEGF01_PEA_1_node_0 | 401 |
| HSEGF01_PEA_1_node_20 | 402 |
| HSEGF01_PEA_1_node_22 | 403 |
| HSEGF01_PEA_1_node_28 | 404 |
| HSEGF01_PEA_1_node_32 | 405 |
| HSEGF01_PEA_1_node_35 | 406 |
| HSEGF01_PEA_1_node_39 | 407 |
| HSEGF01_PEA_1_node_40 | 408 |
| HSEGF01_PEA_1_node_42 | 409 |
| HSEGF01_PEA_1_node_44 | 410 |
| HSEGF01_PEA_1_node_45 | 411 |
| HSEGF01_PEA_1_node_52 | 412 |
| HSEGF01_PEA_1_node_61 | 413 |
| HSEGF01_PEA_1_node_70 | 414 |
| HSEGF01_PEA_1_node_75 | 415 |
| HSEGF01_PEA_1_node_79 | 416 |
| HSEGF01_PEA_1_node_81 | 417 |
| HSEGF01_PEA_1_node_88 | 418 |
| HSEGF01_PEA_1_node_92 | 419 |
| HSEGF01_PEA_1_node_93 | 420 |
| HSEGF01_PEA_1_node_94 | 421 |
| HSEGF01_PEA_1_node_95 | 422 |

TABLE 46

Proteins of interest

| Protein Name | Protein Length | SEQ ID NO | Corresponding Transcript(s) |
|---|---|---|---|
| HSEGF01_PEA_1_P11 | P705 | 423 | HSEGF01_PEA_1_T19 |
| HSEGF01_PEA_1_P14 | P317 | 424 | HSEGF01_PEA_1_T22 |
| HSEGF01_PEA_1_P18 | P215 | 425 | HSEGF01_PEA_1_T27 |
| HSEGF01_PEA_1_P24 | P350 | 426 | HSEGF01_PEA_1_T12 |

These sequences are variants of the known protein Epidermal growth factor receptor precursor (SwissProt accession identifier EGFR_HUMAN (SEQ ID NO: 427); known also according to the synonyms EC 2.7.1.112; Receptor protein-tyrosine kinase ErbB-1), referred to herein as the previously known protein.

Protein Epidermal growth factor receptor precursor is known or believed to have the following function(s): Receptor for EGF, but also for other members of the EGF family, as TGF-alpha, amphiregulin, betacellulin, heparin-binding EGF-like growth factor, GP30 and vaccinia virus growth factor. Is involved in the control of cell growth and differentiation; Isoform 2/truncated isoform may act as an antagonist. The sequence for protein Epidermal growth factor receptor precursor is given in SEQ ID NO: 427, as "Epidermal growth factor receptor precursor amino acid sequence". Known polymorphisms for this sequence are as shown in Table 47.

TABLE 47

Amino acid mutations for Known Protein

| SNP position(s) on amino acid sequence | Comment |
|---|---|
| 540 | N → K |

Protein Epidermal growth factor receptor precursor localization is believed to be Type I membrane protein. Isoform 2 is secreted.

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein or of drugs directed to this protein are as follows: Angiogenesis stimulant; CD8 agonist; Epidermal growth factor agonist; ErbB-1 inhibitor; Fibroblast growth factor agonist; Heparin epidermal growth factor agonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticancer; Vulnerary; Antiulcer; Ophthalmological; Symptomatic antidiabetic; Stomatological; Cardiovascular; GI inflammatory/bowel disorders; Respiratory;

The following GO Annotation(s) apply to the previously known protein. The following annotation(s) were found: protein amino acid phosphorylation; EGF receptor signaling pathway; cell proliferation, which are annotation(s) related to Biological Process; receptor; epidermal growth factor receptor; ATP binding which are annotation(s) related to Molecular Function; and plasma membrane; integral plasma membrane protein, which are annotation(s) related to Cellular Component. The GO assignment relies on information from one or more of the SwissProt/TremB1 Protein knowledgebase, or Locuslink.

As noted above, cluster HSEGF01 features 4 transcript(s), which were listed in Table 44 above. These transcript(s) encode for protein(s) which are variant(s) of protein Epidermal growth factor receptor precursor. A description of each variant protein according to the present invention is now provided.

Ariant protein HSEGF01_PEA_1_P11 (SEQ ID NO:423) is encoded by transcript(s) HSEGF01_PEA_1_T19 (SEQ ID NO: 272). An alignment is given to the known protein (Epidermal growth factor receptor precursor; SEQ ID NO:427) in FIG. 148. One or more alignments to one or more previously published protein sequences are given in FIGS. 149-151. A brief description of the relationship of the variant protein according to the present invention to each such aligned protein is as follows:

Comparison Report Between HSEGF01_PEA_1_P11 (SEQ ID NO: 423) and EGFR_HUMAN (SEQ ID NO: 427):

1. An isolated chimeric polypeptide HSEGF01_PEA_1_P11 (SEQ ID NO: 423), comprising a first amino acid sequence being at least 90% homologous to MRPSGTAGAALLALLAALCPASRALEEKKVCQGTSNKLTQLGTFEDHFLSLQ RMFNNCEVVLGNLEITYVQRNYDLSFLKTIQEVAGYVLIALNTVERIPLENLQI IRGNMYYENSYALAVLSNYDANKTGLKELPMRNLQEILHGAVRFSNNPALC NVESIQWRDIVSSDFLSNMSMDFQNHLGSCQKCDPSCPNGSCWGAGEENCQ KLTKIICAQQCSGRCRGKSPSDCCHNQCAAGCTGPRESDCLVCRKFRDEATC KDTCPPLMLYNPTTYQMDVNPEGKYSFGATCVKKCPRNYVVTDHGSCVRAC GADSYEMEEDGVRKCKKCEGPCRKVCNGIGIGEFKDSLSINATNIKHFKNCTS ISGDLHILPVAFRGDSFTHTPPLDPQELDILKTVKEITGFLLIQAWPENRTDLHA FENLEIIRGRTKQHGQFSLAVVSLNITSLGLRSLKEISDGDVIISGNKNLCYANT INWKKLFGTSGQKTKIISNRGENSCKATGQVCHALCSPEGCWGPEPRDCVSC RNVSRGRECVDKCNLLEGEPREFVENSECIQCHPECLPQAMNITCTGRGPDNC IQCAHYIDGPHCVKTCPAGVMGENNTLVWKYADAGHVCHLCHPNCTYG corresponding to amino acids 1-627 of EGFR_HUMAN, which also corresponds to amino acids 1-627 of HSEGF01_PEA_1_P11 (SEQ ID NO: 423), and a second amino acid sequence being at least 70%, optionally at least 80%, preferably at least 85%, more preferably at least 90% and most preferably at least 95% homologous to a polypeptide having the sequence PGNESLKAMLFCLFKLSSCNQSNDGSVSHQSGSPAAQESCLGWIPSLLPSEFQL GWGGCSHLHAWPSASVIITASSCH corresponding to amino acids 628-705 of HSEGF01_PEA_1_P11 (SEQ ID NO: 423), wherein said first amino acid sequence and second amino acid sequence are contiguous and in a sequential order.

2. An isolated polypeptide for a tail of HSEGF01_PEA_1_P11 (SEQ ID NO: 423), comprising a polypeptide being at least 70%, optionally at least about 80%, preferably at least about 85%, more preferably at least about 90% and most preferably at least about 95% homologous to the sequence PGNESLKAMLFCLFKLSSCNQSNDGSVSHQSGSPAAQESCLGWIPSLLPSEFQL GWGGCSHLHAWPSASVIITASSCH in HSEGF01_PEA_1_P11 (SEQ ID NO: 423).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSEGF01_PEA_1_P11 (SEQ ID NO: 423) also has the following non-silent SNPs (Single Nucleotide Polymorphisms) as listed in Table 48, (given according to their position(s) on the amino acid sequence, with the alternative amino acid(s) listed; the last column indicates whether the SNP is known or not; the presence of known SNPs in variant protein HSEGF01_PEA_1_P11 (SEQ ID NO: 423) sequence provides support for the deduced sequence of this variant protein according to the present invention).

TABLE 48

| Amino acid mutations | | |
|---|---|---|
| SNP position(s) on amino acid sequence | Alternative amino acid(s) | Previously known SNP? |
| 141 | Q → * | No |
| 234 | N → S | No |

The glycosylation sites of variant protein HSEGF01_PEA_1_P11 (SEQ ID NO: 423), as compared to the known protein Epidermal growth factor receptor precursor, are described in Table 49 (given according to their position(s) on the amino acid sequence in the first column; the second column indicates whether the glycosylation site is present in the variant protein; and the last column indicates whether the position is different on the variant protein).

TABLE 49

| Glycosylation site(s) | | |
|---|---|---|
| Position(s) on known amino acid sequence | Present in variant protein? | Position in variant protein? |
| 56 | yes | 56 |
| 568 | yes | 568 |
| 128 | yes | 128 |
| 413 | yes | 413 |
| 603 | yes | 603 |
| 352 | yes | 352 |
| 361 | yes | 361 |
| 175 | yes | 175 |
| 444 | yes | 444 |
| 528 | yes | 528 |

The phosphorylation sites of variant protein HSEGF01_PEA_1_P11, as compared to the known protein Epidermal growth factor receptor precursor, are described in Table 50 (given according to their position(s) on the amino acid sequence in the first column; the second column indicates whether the phosphorylation site is present in the variant protein; and the last column indicates whether the position is different on the variant protein).

TABLE 50

Phosphorylation site(s)

| Position(s) on known amino acid sequence | Present in variant protein? | Position in variant protein? |
|---|---|---|
| 1197 | no | |
| 678 | no | |
| 1110 | no | |
| 1172 | no | |
| 1092 | no | |

The variant protein has the following domains, as determined by using InterPro. The domains are described in Table 51:

TABLE 51

InterPro domain(s)

| InterPro ID | Domain description | Analysis type | Position(s) on protein |
|---|---|---|---|
| IPR001450 | 4Fe—4S ferredoxin, iron-sulfur binding domain | FPrintScan | 548-559, 590-601 |
| IPR006211 | Furin-like cysteine rich region | HMMPfam | 184-338 |
| IPR000494 | Epidermal growth-factor receptor (EGFR), L domain | HMMPfam | 361-481, 57-168 |
| IPR006212 | Furin-like repeat | HMMSmart | 228-270, 496-547, 552-601 |
| IPR000345 | Cytochrome c heme-binding site | ScanRegExp | 555-560 |

Variant protein HSEGF01_PEA_1_P11 (SEQ ID NO: 423) is encoded by the HSEGF01_PEA_1_T19 (SEQ ID NO:372). The coding portion of transcript HSEGF01_PEA_1_T19 (SEQ ID NO: 372) starts at position 504 and ends at position 2618. The transcript also has the following SNPs as listed in Table 52 (given according to their position on the nucleotide sequence, with the alternative nucleic acid listed; the last column indicates whether the SNP is known or not; the presence of known SNPs in variant protein HSEGF01_PEA_1_P11 (SEQ ID NO: 423) sequence provides support for the deduced sequence of this variant protein according to the present invention).

TABLE 52

Nucleic acid SNPs

| SNP position on nucleotide sequence | Alternative nucleic acid | Previously known SNP? |
|---|---|---|
| 288 | G → T | No |
| 313 | C → A | No |
| 352 | G → | No |
| 758 | G → T | No |
| 924 | C → T | No |
| 977 | T → C | No |
| 1204 | A → G | No |
| 3258 | T → A | No |

Variant protein HSEGF01_PEA_1_P14 (SEQ ID NO: 424) is encoded by transcript(s) HSEGF01_PEA_1_T22 (SEQ ID NO: 373). An alignment is given to the known protein (Epidermal growth factor receptor precursor; SEQ ID NO:427) is presented in FIG. 149. One or more alignments to one or more previously published protein sequences are given in FIGS. 148, 150 and 151. A brief description of the relationship of the variant protein according to the present invention to each such aligned protein is as follows:

Comparison Report Between HSEGF01_PEA_P14 (SEQ ID NO: 424) and EGFR_HUMAN (SEQ ID NO: 427):

1. An isolated chimeric polypeptide HSEGF01_PEA_1_P14 (SEQ ID NO: 424), comprising a first amino acid sequence being at least 90% homologous to MRPSGTAGAALLALLAALCPASRALEEKKVC-QGTSNKLTQLGTFEDHFLSLQ RMFNNCEVVLGNLE-ITYVQRNYDLSFLKTIQEVAGYVLIALNTVERIPLENL-QIIRGNMYYENSYALAVLSNYDANKT-GLKELPMRNLQEILHGAVRFSNNPALC NVE-SIQWRDIVSSDFLSNMSMDFQNHLGSC-QKCDPSCPNGSCWGAGEENCQ KLTKIICAQQCSGRCRGKSPSDCCHNQ-CAAGCTGPRESDCLVCRKFRDEATC KDTCPPLM-LYNPTTYQMDVNPEGKYSFGATCVKKCPR corresponding to amino acids 1-297 of EGFR_HUMAN, which also corresponds to amino acids 1-297 of HSEGF01_PEA_1_P14 (SEQ ID NO: 424), and a second amino acid sequence being at least 70%, optionally at least 80%, preferably at least 85%, more preferably at least 90% and most preferably at least 95% homologous to a polypeptide having the sequence ESSSVGPLTGQASLSRSVSC corresponding to amino acids 298-317 of HSEGF01_PEA_1_P14 (SEQ ID NO: 424), wherein said first amino acid sequence and second amino acid sequence are contiguous and in a sequential order.

2. An isolated polypeptide for a tail of HSEGF01_PEA_1_P14 (SEQ ID NO: 424), comprising a polypeptide being at least 70%, optionally at least about 80%, preferably at least about 85%, more preferably at least about 90% and most preferably at least about 95% homologous to the sequence ESSSVGPLTGQASLSRSVSC in HSEGF01_PEA_1_P14 (SEQ ID NO: 424).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSEGF01_PEA_1_P14 (SEQ ID NO: 424) also has the following non-silent SNPs (Single Nucleotide Polymorphisms) as listed in Table 53, (given according to their position(s) on the amino acid sequence, with the alternative amino acid(s) listed; the last column indicates whether the SNP is known or not; the presence of known SNPs in variant protein HSEGF01_PEA_1_P14 (SEQ ID NO: 424) sequence provides support for the deduced sequence of this variant protein according to the present invention).

TABLE 53

Amino acid mutations

| SNP position(s) on amino acid sequence | Alternative amino acid(s) | Previously known SNP? |
|---|---|---|
| 141 | Q → * | No |
| 234 | N → S | No |

The glycosylation sites of variant protein HSEGF01_PEA_1_P14 (SEQ ID NO: 424), as compared to the known protein Epidermal growth factor receptor precursor, are described in Table 54 (given according to their position(s) on the amino acid sequence in the first column; the second column indicates whether the glycosylation site is present in the variant protein; and the last column indicates whether the position is different on the variant protein).

TABLE 54

Glycosylation site(s)

| Position(s) on known amino acid sequence | Present in variant protein? | Position in variant protein? |
|---|---|---|
| 56 | yes | 56 |
| 568 | no | |
| 128 | yes | 128 |
| 413 | no | |
| 603 | no | |
| 352 | no | |
| 361 | no | |
| 175 | yes | 175 |
| 444 | no | |
| 528 | no | |

The phosphorylation sites of variant protein HSEGF01_PEA_1_P14 (SEQ ID NO: 424), as compared to the known protein Epidermal growth factor receptor precursor, are described in Table 55 (given according to their position(s) on the amino acid sequence in the first column; the second column indicates whether the phosphorylation site is present in the variant protein; and the last column indicates whether the position is different on the variant protein).

TABLE 55

Phosphorylation site(s)

| Position(s) on known amino acid sequence | Present in variant protein? | Position in variant protein? |
|---|---|---|
| 1197 | no | |
| 678 | no | |
| 1110 | no | |
| 1172 | no | |
| 1092 | no | |

The variant protein has the following domains, as determined by using InterPro. The domains are described in Table 56:

TABLE 56

InterPro domain(s)

| InterPro ID | Domain description | Analysis type | Position(s) on protein |
|---|---|---|---|
| IPR006211 | Furin-like cysteine rich region | HMMPfam | 184-317 |
| IPR000494 | Epidermal growth-factor receptor (EGFR), L domain | HMMPfam | 57-168 |
| IPR006212 | Furin-like repeat | HMMSmart | 228-270 |

Variant protein HSEGF01_PEA_1_P14 (SEQ ID NO:424) is encoded by the following transcript(s): HSEGF01_PEA_1_T22 (SEQ ID NO:373). The coding portion of transcript HSEGF01_PEA_1_T22 (SEQ ID NO:373) starts at position 504 and ends at position 1454. The transcript also has the following SNPs as listed in Table 57 (given according to their position on the nucleotide sequence, with the alternative nucleic acid listed; the last column indicates whether the SNP is known or not; the presence of known SNPs in variant protein HSEGF01_PEA_1_P14 (SEQ ID NO:424) sequence provides support for the deduced sequence of this variant protein according to the present invention).

TABLE 57

Nucleic acid SNPs

| SNP position on nucleotide sequence | Alternative nucleic acid | Previously known SNP? |
|---|---|---|
| 288 | G → T | No |
| 313 | C → A | No |
| 352 | G → | No |
| 758 | G → T | No |
| 924 | C → T | No |
| 977 | T → C | No |
| 1204 | A → | No |

Variant protein HSEGF01_PEA_1_P18 (SEQ ID NO:425) according to the present invention is encoded by transcript(s) HSEGF01_PEA_1_T27 (SEQ ID NO:374). An alignment is given to the known protein (Epidermal growth factor receptor precursor) in FIG. 150. A brief description of the relationship of the variant protein according to the present invention to each such aligned protein is as follows:

Comparison Report Between HSEGF01_PEA_1_P18 (SEQ ID NO:425) and EGFR_HUMAN (SEQ ID NO:427):

1. An isolated chimeric polypeptide HSEGF01_PEA_1_P18 (SEQ ID NO:425), comprising a first amino acid sequence being at least 90% homologous to MRPSGTAGAALLALLAALCPASRALEEKKVCQGTSNKL TQLGTFEDHFLSLQRMFNNCEVVLGNLE-ITYVQRNYDLSELKTIQEVAGYV-LIALNTVERIPLENLQI IRGNMYYENSYALAVLSNY-DANKTGLKELPMRNLQEILHGAVRFSNNPALC NVESIQWRDIVSSDFLSNMSMDFQNHLGSC corresponding to amino acids 1-187 of EGFR_HUMAN (SEQ ID NO:427), which also corresponds to amino acids 1-187 of HSEGF01_PEA_1_P18 (SEQ ID NO:425), and a second amino acid sequence being at least 70%, optionally at least 80%, preferably at least 85%, more preferably at least 90% and most preferably at least 95% homologous to a polypeptide having the sequence KCRIHTISASSSYGGQLYST-GAGERSHV corresponding to amino acids 188-215 of HSEGF01_PEA_1_P18 (SEQ ID NO:425), wherein said first amino acid sequence and second amino acid sequence are contiguous and in a sequential order.

2. An isolated polypeptide for a tail of HSEGF01_PEA_1_P18 (SEQ ID NO:425), comprising a polypeptide being at least 70%, optionally at least about 80%, preferably at least about 85%, more preferably at least about 90% and most preferably at least about 95% homologous to the sequence KCRIHTISASSSYGGQLYSTGAGERSHV in HSEGF01_PEA_1_P18 (SEQ ID NO:425).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSEGF01_PEA_1_P18 (SEQ ID NO:425) also has the following non-silent SNPs (Single Nucleotide Polymorphisms) as listed in Table 58, (given according to their position(s) on the amino acid sequence, with the alternative amino acid(s) listed; the last column indicates whether the SNP is known or not; the presence of known SNPs in variant protein HSEGF01_PEA_1_P18 (SEQ ID NO:425) sequence provides support for the deduced sequence of this variant protein according to the present invention).

TABLE 58

Amino acid mutations

| SNP position(s) on amino acid sequence | Alternative amino acid(s) | Previously known SNP? |
|---|---|---|
| 141 | Q → * | No |

The glycosylation sites of variant protein HSEGF01_PEA_1_P18 (SEQ ID NO:425), as compared to the known protein Epidermal growth factor receptor precursor, are described in Table 59 (given according to their position(s) on the amino acid sequence in the first column; the second column indicates whether the glycosylation site is present in the variant protein; and the last column indicates whether the position is different on the variant protein).

TABLE 59

Glycosylation site(s)

| Position(s) on known amino acid sequence | Present in variant protein? | Position in variant protein? |
|---|---|---|
| 56 | yes | 56 |
| 568 | no | |
| 128 | yes | 128 |
| 413 | no | |
| 603 | no | |
| 352 | no | |
| 361 | no | |
| 175 | yes | 175 |
| 444 | no | |
| 528 | no | |

The phosphorylation sites of variant protein HSEGF01_PEA_1_P18 (SEQ ID NO:425), as compared to the known protein Epidermal growth factor receptor precursor, are described in Table 60 (given according to their position(s) on the amino acid sequence in the first column; the second column indicates whether the phosphorylation site is present in the variant protein; and the last column indicates whether the position is different on the variant protein).

TABLE 60

Phosphorylation site(s)

| Position(s) on known amino acid sequence | Present in variant protein? | Position in variant protein? |
|---|---|---|
| 1197 | No | |
| 678 | No | |
| 1110 | No | |
| 1172 | No | |
| 1092 | No | |

The variant protein has the following domains, as determined by using InterPro. The domains are described in Table 61:

TABLE 61

InterPro domain(s)

| InterPro ID | Domain description | Analysis type | Position(s) on protein |
|---|---|---|---|
| IPR000494 | Epidermal growth-factor receptor (EGFR), L domain | HMMPfam | 57-168 |

Variant protein HSEGF01_PEA_1_P18 (SEQ ID NO:425) is encoded by the following transcript(s): HSEGF01_PEA_1_T27 (SEQ ID NO:374). The coding portion of transcript HSEGF01_PEA_1_T27 (SEQ ID NO:374) is starts at position 504 and ends at position 1148. The transcript also has the following SNPs as listed in Table 62 (given according to their position on the nucleotide sequence, with the alternative nucleic acid listed; the last column indicates whether the SNP is known or not; the presence of known SNPs in variant protein HSEGF01_PEA_1_P18 (SEQ ID NO:425) sequence provides support for the deduced sequence of this variant protein according to the present invention).

TABLE 62

Nucleic acid SNPs

| SNP position on nucleotide sequence | Alternative nucleic acid | Previously known SNP? |
|---|---|---|
| 288 | G → T | No |
| 313 | C → A | No |
| 352 | G → | No |
| 758 | G → T | No |
| 924 | C → T | No |
| 977 | T → C | No |
| 1276 | T → G | No |
| 1317 | A → G | No |
| 1440 | C → T | No |
| 1503 | A → G | No |

Variant protein HSEGF01_PEA_1_P24 (SEQ ID NO:426) according to the present invention is encoded by transcript(s) HSEGF01_PEA_1_T12 (SEQ ID NO:371). An alignment is given to the known protein (Epidermal growth factor receptor precursor) in FIG. 151. A brief description of the relationship of the variant protein according to the present invention to each such aligned protein is as follows:

Comparison Report Between HSEGF01_PEA_1_P24 (SEQ ID NO:426) and EGFR_HUMAN (SEQ ID NO:427):

1. An isolated chimeric polypeptide HSEGF01_PEA_1_P24 (SEQ ID NO:426), comprising a first amino acid sequence being at least 90% homologous to MRPSGTAGAALLALLAALCPASRALEEKKVC-QGTSNKLTQLGTFEDHFLSLQ RMFNNCEVVLGNLE-ITYVQRNYDLSFLKTIQEVAGYVLIALNTVERIPLENL-QI IRGNMYYENSYALAVLSNYDANKT-GLKELPMRNLQEILHGAVRFSNNPALC NVE-SIQWRDIVSSDFLSNMSMDFQNHLGSC-QKCDPSCPNGSCWGAGEENCQ KLTKIICAQQCSGRCRGKSPSDCCHNQ-CAAGCTGPRESDCLVCRKFRDEATC KDTCPPLM-LYNPTTYQMDVNPEGKYSF-GATCVKKCPRNYVVTDHGSCVRAC GADSYEMEEDGVRKCKKCEGPCRK corresponding to amino acids 1-335 of EGFR_HUMAN (SEQ ID NO:427), which also corresponds to amino acids 1-335 of HSEGF01_PEA_1_P24 (SEQ ID NO:426), and a second amino acid sequence being at least 70%, optionally at least 80%, preferably at least 85%, more preferably at least 90% and most preferably at least 95% homologous to a polypeptide having the sequence GRKPAGVRTRLVLGC corresponding to amino acids 336-350 of HSEGF01_PEA_1_P24 (SEQ ID NO:426), wherein said first amino acid sequence and second amino acid sequence are contiguous and in a sequential order.

2. An isolated polypeptide for a tail of HSEGF01_PEA_1_P24 (SEQ ID NO:426), comprising a polypeptide being at least 70%, optionally at least about 80%, preferably at least about 85%, more preferably at least about 90% and most preferably at least about 95% homologous to the sequence GRKPAGVRTRLVLGC in HSEGF01_PEA_1_P24 (SEQ ID NO:426).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSEGF01_PEA_1_P24 (SEQ ID NO:426) also has the following non-silent SNPs (Single Nucleotide Polymorphisms) as listed in Table 63, (given according to their position(s) on the amino acid sequence, with the alternative amino acid(s) listed; the last column indicates whether the SNP is known or not; the presence of known SNPs in variant protein HSEGF01_PEA_1_P24 (SEQ ID NO:426) sequence provides support for the deduced sequence of this variant protein according to the present invention).

TABLE 63

Amino acid mutations

| SNP position(s) on amino acid sequence | Alternative amino acid(s) | Previously known SNP? |
|---|---|---|
| 141 | Q → * | No |
| 234 | N → S | No |

The glycosylation sites of variant protein HSEGF01_PEA_1_P24 (SEQ ID NO:426), as compared to the known protein Epidermal growth factor receptor precursor, are described in Table 64 (given according to their position(s) on the amino acid sequence in the first column; the second column indicates whether the glycosylation site is present in the variant protein; and the last column indicates whether the position is different on the variant protein).

TABLE 64

Glycosylation site(s)

| Position(s) on known amino acid sequence | Present in variant protein? | Position in variant protein? |
|---|---|---|
| 56 | yes | 56 |
| 568 | no | |
| 128 | yes | 128 |
| 413 | no | |
| 603 | no | |
| 352 | no | |
| 361 | no | |
| 175 | yes | 175 |

TABLE 64-continued

Glycosylation site(s)

| Position(s) on known amino acid sequence | Present in variant protein? | Position in variant protein? |
|---|---|---|
| 444 | no | |
| 528 | no | |

The phosphorylation sites of variant protein HSEGF01_PEA_1_P24 (SEQ ID NO:426), as compared to the known protein Epidermal growth factor receptor precursor, are described in Table 65 (given according to their position(s) on the amino acid sequence in the first column; the second column indicates whether the phosphorylation site is present in the variant protein; and the last column indicates whether the position is different on the variant protein).

TABLE 65

Phosphorylation site(s)

| Position(s) on known amino acid sequence | Present in variant protein? | Position in variant protein? |
|---|---|---|
| 1197 | no | |
| 678 | no | |
| 1110 | no | |
| 1172 | no | |
| 1092 | no | |

The variant protein has the following domains, as determined by using InterPro. The domains are described in Table 66:

TABLE 66

InterPro domain(s)

| InterPro ID | Domain description | Analysis type | Position(s) on protein |
|---|---|---|---|
| IPR006211 | Furin-like cysteine rich region | HMMPfam | 184-338 |
| IPR000494 | Epidermal growth-factor receptor (EGFR), L domain | HMMPfam | 57-168 |
| IPR006212 | Furin-like repeat | HMMSmart | 228-270 |

Variant protein HSEGF01_PEA_1_P24 (SEQ ID NO:426) is encoded by the following transcript(s): HSEGF01_PEA_1_T12 (SEQ ID NO:371). The coding portion of transcript HSEGF01_PEA_1_T12 (SEQ ID NO:371) starts at position 504 and ends at position 1553. The transcript also has the following SNPs as listed in Table 67 (given according to their position on the nucleotide sequence, with the alternative nucleic acid listed; the last column indicates whether the SNP is known or not; the presence of known SNPs in variant protein HSEGF01_PEA_1_P24 (SEQ ID NO:426) sequence provides support for the deduced sequence of this variant protein according to the present invention).

TABLE 67

Nucleic acid SNPs

| SNP position on nucleotide sequence | Alternative nucleic acid | Previously known SNP? |
|---|---|---|
| 288 | G → T | No |
| 313 | C → A | No |

TABLE 67-continued

Nucleic acid SNPs

| SNP position on nucleotide sequence | Alternative nucleic acid | Previously known SNP? |
|---|---|---|
| 352 | G → | No |
| 758 | G → T | No |
| 924 | C → T | No |
| 977 | T → C | No |
| 1204 | A → G | No |
| 2976 | T → A | No |
| 3095 | G → T | No |
| 3450 | G → A | No |
| 3798 | C → T | No |
| 4410 | T → C | No |
| 4418 | A → G | No |
| 4805 | G → | No |
| 4960 | T → | No |
| 4971 | A → T | No |
| 5496 | T → C | No |
| 6894 | G → A | No |
| 7422 | G → A | No |
| 7801 | G → C | No |
| 7979 | T → C | No |
| 8799 | C → T | No |
| 9038 | C → G | No |
| 9376 | G → A | No |
| 9934 | C → G | No |
| 9934 | C → T | No |
| 10264 | C → A | No |
| 10264 | C → G | No |
| 10332 | → C | No |
| 10332 | → G | No |
| 10369 | T → G | No |
| 10692 | A → C | No |

Figure 34:
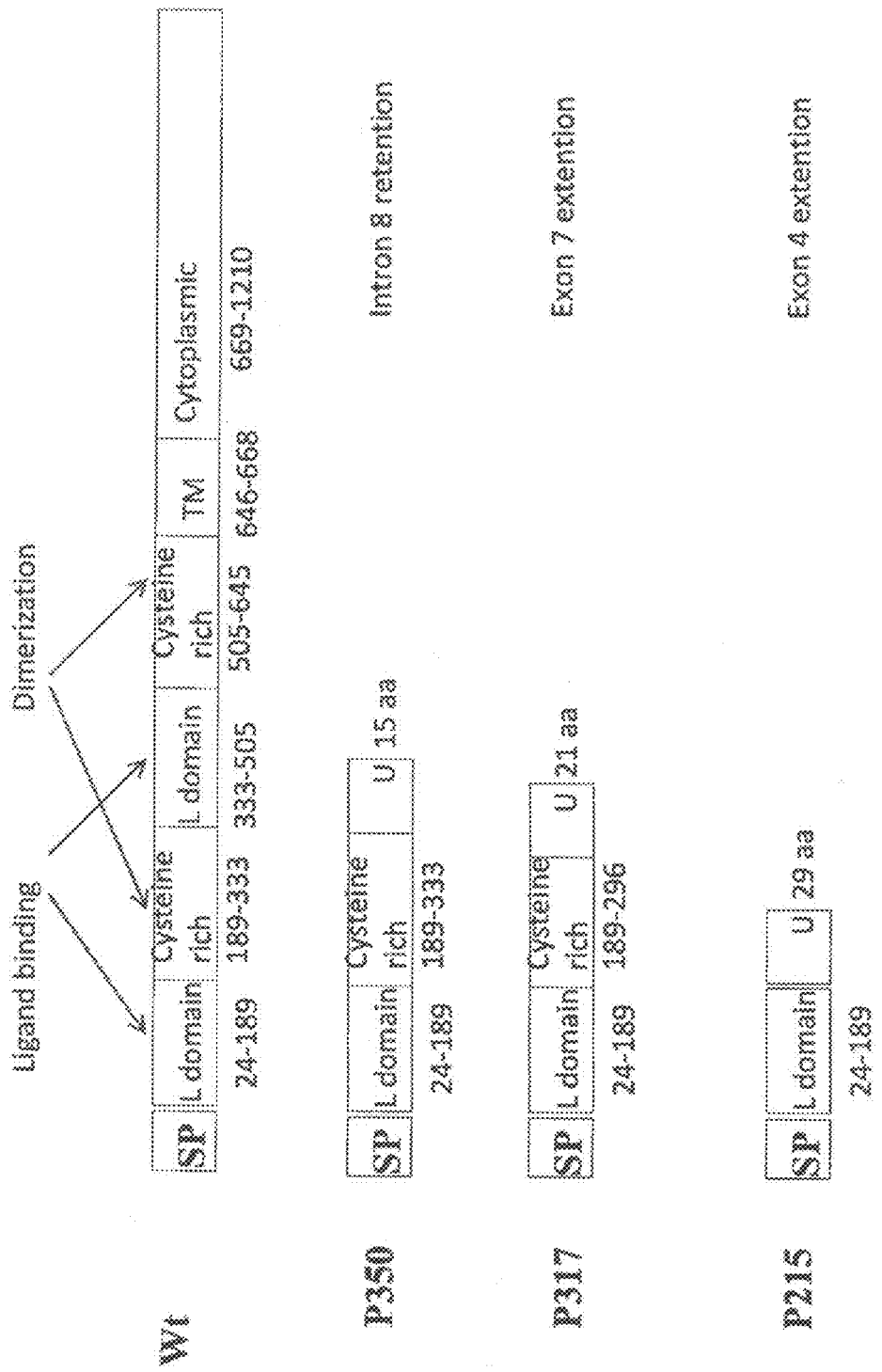
FIG. 34 presents the domain structure of the variants described in Example 42.

FIG. 34 presents the domain structure of the variants described hereinabove.

Example 43

Splice Variant of Insulin-Like Growth Factor Binding Protein 3 Precursor

Background

The insulin-like growth factor system, which includes insulin-like growth factors (IGF-I and IGF-II), IGF receptors (IGF-IR and IGF-IIR) and IGF binding proteins (IGFBPs), plays an important role in epithelial growth, anti-apoptosis and mitogenesis. The IGFs are not stored within cells of a specific tissue but are present at very high levels throughout the body. They circulate at total concentrations approximately 1000 times higher than that of most peptide hormones and although tissue levels are somewhat lower, they are still present in vast excess compared to that required for maximal cellular stimulation. These high levels are maintained due to their association with the IGFBPs, which dramatically slow their clearance. The IGFBPs bind the IGFs with greater affinity than their cell surface receptors, enabling them to tightly control tissue activity. The IGFBP proteases modify the IGFBPs, lowering the affinity with which they bind IGFs. In the tissues the IGFs are important regulators of cell survival, growth, metabolism and differentiated function; the complex system confers specificity on these actions. The complex of IGF-I and IGFBP-3 ("binary complex" or "IGF-I/IGFBP-3") is considerably different from uncomplexed IGF-I, both physically and chemically. The binary complex is approximately 5 times larger than uncomplexed IGF-I, has a different overall pI, and has a different overall hydrophobicity. These differences cause the binary complex to behave quite differently than IGF-I.

Due to its wide range of activities, IGF-I has been developed as a treatment for a variety of conditions, including amyotrophic lateral sclerosis (commonly known as Lou Gehrig's disease) and diabetes. Unfortunately, the administration of IGF-I is accompanied by a variety of undesirable side effects, including hypoglycemia, edema (which can cause Bell's palsy, carpal tunnel syndrome, and a variety of other deleterious conditions), hypophosphatemia (low serum phosphorus), and hypernatermia (excessive serum sodium). Administration of IGF-I as a complex of IGF-I and IGFBP-3 can reduce or eliminate these undesirable side effects (Adams et al., 1996, Prog. Growth Factor Res. 6:2-4).

While administration of IGF-I/IGFBP-3 complex may be desirable, the complex, like many proteins, has very limited stability (shelf life) in most formulations. The formulations thus disclosed for IGF-I/IGFBP-3 have been unsatisfactory due to poor stability of the proteins. Formulations which can be stored at normal refrigerator temperatures or higher while still providing a long shelf life are critical to the commercial development of IGF-I/IGFBP for use as a therapeutic.

Catabolic conditions in which debilitating nitrogen wasting or protein wasting occurs include, but are not limited to, chronic obstructive pulmonary disease, gastrointestinal tract resections or disorders, illnesses requiring corticosteroid therapy, diabetes, trauma, pneumonia, heart failure, stroke, cancer cachexia, and AIDS cachexia. Severe loss of body protein substantially increases chances for dying and/or prolonged hospitalization and major medical expenses. An additional group of patients who are at risk of negative nitrogen balance are patients in hospitals or nursing homes who are convalescing from acute illnesses.

Administration of IGFBP-3 or IGF/IGFBP-3 complex has been proposed for a variety of conditions and diseases, for example, for wound healing and systemic tissue repair in burns, trauma, ulcers, surgery, etc (U.S. Pat. No. 5,407,913 to Sommer et al); for renal disease, renal toxicity, autoimmune nephropathy, and renal dysfunction (U.S. Pat. No. 5,723,441 to Higley et al); for protein wasting and other catabolic disease (U.S. Pat. No. 5,643,867 to Maack et al) and for increasing low sex steroid levels in the elderly (U.S. Pat. No. 6,025,332 to Mascarenhas).

There is a growing body of evidence showing that IGFs control growth and proliferation of several types of cancer. The growth promoting effects of IGF-I and IGF-II on cancer cells are mediated through the IGF-IR, which is a tyrosine kinase. Cancer cells with a strong tendency to metastasize have a higher expression of the IGF-IR. Most of the IGFs in circulation are bound to the IGFBPs, which regulate the bioavailability of the IGFs. All IGFBPs inhibit IGF action by high affinity binding, while some of them also potentiate the effects of IGFs. Some cancer cells produce specific proteases that degrade the IGFBP so that the IGF will be free to act on the cancer cell in an autocrine manner. Therefore, the IGFBPs play a crucial role in the development of cancer. The correlation of high IGF and low IGFBP-3 levels in prostate and other cancers has lead to the development of cancer diagnostic methods for prostate cancer (U.S. Pat. No. 6,645,770 to Pollack et al) and breast cancer. Rechler et al (Endocrinol. 2000 138:2645-47) have proposed treatment of breast cancer with IGFBP-3, to inhibit the mitogenic effects of IGF.

IGF/IGFBP-3 complex is critical for musculoskeletal growth and development, and IGFBP-3 may both inhibit, or potentiate effects of IGF on growth (Oksbjerg et al Domestic Anim Endocrinology 1996 27; 219-240). Thus, measurement of IGF or IGFBP-3 has been proposed for indicating feed conversion, growth rate and reproductive capacity in the selection of livestock (U.S. Pat. No. 6,090,569 to Owens et al.).

Splice Variants S56205_T7 (SEQ ID NO:286) and S56205_T15 (SEQ ID NO:288) Encode New Secreted Forms of Insulin-Like Growth Factor Binding Protein 3 Precursor (IGFBP-3) S56205_P7 (SEQ ID NO:285) and S56205_P15 (SEQ ID NO:287), Respectively.

S56205_P7 (SEQ ID NO:285)

The present inventors have uncovered a new IGFBP-3 precursor variant [S56205_P7 (SEQ ID NO:285), S56205_T7 (SEQ ID NO:286). The protein coordinates on the transcript start from nucleotide 151 and end at nucleotide 1042, as set forth in SEQ ID NO: 286.

Alignment of the new IGFBP-3 precursor variant [S56205_P2 (SEQ ID NO:285] with the WT Insulin-like growth factor binding protein 3 precursor (GenBank Accession NO. P17936; IBP3_HUMAN (SEQ ID NO:647), as shown in FIG. 125, revealed the presence of a unique amino acid sequence (PPAPGE, SEQ ID NO:659). The new variant uncovered by the present invention is expected to be a secreted, extracellular protein having IGF binding properties and useful in the treatment and diagnosis of all musculoskeletal disorders, amyotrophic lateral sclerosis (ALS), burns, cachexia, cancers of all types, Type I and Type II diabetes, dwarfism, Growth hormone (GH) deficiency, hormone replacement therapy (HRT), general neuropathy, osteoporosis, bone regeneration, wound healing, psoriasis, cerebral ischaemia, prostate and breast cancer, sexual dysfunction, neurological and opthalmalogical disorders, and for selection and breeding of livestock.

Comparison Report Between S56205_P7 and IBP3_HUMAN (SEQ ID NO:647)

1. An isolated chimeric polypeptide S56205_P7, comprising a first amino acid sequence being at least 90% homologous to MQRARPTLWAAALTLLVLLRGPPVARA-GASSGGLGPVVRCEPCDARALAQC APPPAVCAELVREPGCGCCLTCALSEG-QPCGIYTERCGSGLRCQPSPDEARPL QALLDGR-GLCVNASAVSRLRAYLLPA corresponding to amino acids 1-130 of IBP3_HUMAN, which also corresponds to amino acids 1-130 of S56205_P7, a second amino acid sequence being at least 70%, optionally at least 80%, preferably at least 85%, more preferably at least 90% and most preferably at least 95% homologous to a polypeptide having the sequence PPAPGE (SEQ ID NO:659) corresponding to amino acids 131-136 of S56205_P7, and a third amino acid sequence being at least 90% homologous to PPAPGNAS-ESEEDRSAGSVESPSVSSTHRVSDPKFH-PLHSKIIIIKKGHAKDSQR YKVDYESQSTDTQNFSS-ESKRETEYGPCRREMEDTLNHLKFLNVLSPRGVHIP NCDKKGFYKKKQCRPSKGRKRGFCWCVD-KYGQPLPGYTTKGKEDVHCYSM QSK corresponding to amino acids 131-291 of IBP3_HUMAN, which also corresponds to amino acids 137-297 of S56205_P7, wherein said first amino acid sequence, second amino acid sequence and third amino acid sequence are contiguous and in a sequential order.

2. An isolated polypeptide for an edge portion of S56205_P7, comprising an amino acid sequence being at least 70%, optionally at least about 80%, preferably at least about 85%, more preferably at least about 90% and most preferably at least about 95% homologous to the sequence encoding for PPAPGE, corresponding to S56205_P7.

S56205_P15 (SEQ ID NO:287)

The present inventors have uncovered a new IGFBP-3 precursor variant [S56205_P15 (SEQ ID NO:287), S56205_T15 (SEQ ID NO:288). The protein coordinates on the transcript start from nucleotide 134 and end at nucleotide 1019, as set forth in SEQ ID NO: 288.

Alignment of the new IGFBP-3 precursor variant [S56205_P15 (SEQ ID NO:287)] with the WT Insulin-like growth factor binding protein 3 precursor (IBP3_HUMAN; SEQ ID NO:647), as shown in FIG. 126, revealed that the interpro domain(s) Thyroglobulin type-1 repeat IPR000716 (amino acids 212-281 of GenBank Accession No. P17936, SEQ ID NO:647) is missing, and that the new IGFBP-3 precursor variant has an additional 10 cysteine (Cys) residues. The new variant uncovered by the present invention is expected to be a secreted, extracellular protein having IGF binding properties and useful in the treatment and diagnosis of all musculoskeletal disorders, amyotrophic lateral sclerosis (ALS), burns, cachexia, cancers of all types, Type I and Type II diabetes, dwarfism, Growth hormone (GH) deficiency, hormone replacement therapy (HRT), general neuropathy, osteoporosis, bone regeneration, wound healing, psoriasis, cerebral ischaemia, prostate and breast cancer, sexual dysfunction, neurological and opthalmalogical disorders, and for selection and breeding of livestock.

Comparison Report Between S56205_P15 and IBP3_HUMAN (SEQ ID NO:647)

1. An isolated chimeric polypeptide S56205_P15, comprising a first amino acid sequence being at least 90% homologous to MQRARPTLWAAALTLLVLLRGPP-VARAGASS corresponding to amino acids 1-31 of IBP3_HUMAN, which also corresponds to amino acids 1-31 of S56205_P15, a bridging amino acid A corresponding to amino acid 32 of S56205_P15, a second amino acid sequence being at least 90% homologous to GLGPVVRCEPC-DARALAQCAPPPAVCAELVREPGCGC-CLTCALSEGQPCGIY TERCGSGLRCQPSPDEAR-PLQALLDGRGLCVNASAVSRLRAYLLPAPPAP corresponding to amino acids 33-134 of IBP3_HUMAN, which also corresponds to amino acids 33-134 of S56205_P15, and a third amino acid sequence being at least 70%, optionally at least 80%, preferably at least 85%, more preferably at least 90% and most preferably at least 95% homologous to a polypeptide having the sequence AAR-LGRQMRALRLGAEDQPLPAWIPQLRAVY-CRPIPARPACQAACPGCRRHA AGATHALGRCADSA-GAAPRAAGGAGWRELGGLGSRGALRDRCRRCWTAA GSASTLVPSAACAPTCCQRRQLQEMLVS-RRKTAAPAVWRARPSPARTGCLIP SSTPSIQR (SEQ ID NO:660) corresponding to amino acids 135-295 of S56205_P15, wherein said first amino acid sequence, bridging amino acid, second amino acid sequence and third amino acid sequence are contiguous and in a sequential order.

2. An isolated polypeptide for a tail of S56205_P15, comprising a polypeptide being at least 70%, optionally at least about 80%, preferably at least about 85%, more preferably at least about 90% and most preferably at least about 95% homologous to the sequence AARLGRQMRALRLGAEDQ-PLPAWIPQLRAVYCRPIPARPACQAACPGCRRHA AGATHALGRCADSAGAAPRAAGGAG-WRELGGLGSRGALRDRCRRCWTAA GSASTLVPSAA-CAPTCCQRRQLQEMLVSRRKTAA-PAVWRARPSPARTGCLIP SSTPSIQR in S56205_P15.

Clinical Applications of the Insulin-Like Growth Factor Binding Protein 3 Precursor Variants of the Present Invention Native (WT) IGFBP-3 (GenBank Accession No. P17936, SEQ ID NO:647) comprises numerous functions, such as IGF binding, protease sensitivity, and nuclear localization, which, when combined, provide IGFBP-3 the capability to carefully regulate effective levels of IGF. It will be appreciated that alterations in amino acid sequence of the type disclosed herein for the IGFBP-3 precursor variants of the present invention [S56205_P7 (SEQ ID NO:285) and S56205_P15 (SEQ ID NO:287)] can result in increase or decrease of many of the IGFBP-3 activities, and as such the new variants can compete with the endogenous IGFBP-3 protein and related peptides, and interfere with their various activities, most importantly, IGF binding and exchange, and, indirectly, effect IGF-IGF receptor binding.

Alteration in IGFBP-3 protein sequence has been used for diagnostic and therapeutic applications. Rechler et al (U.S. patent application Ser. No. 10/499,379) discloses IGFBP-3 mutants without IGF binding capability, for inhibition of DNA synthesis and induction of apoptosis. Mascarenhas (U.S. patent application Ser. Nos. 10/264,672 an 09/956,508) teaches the use of IGFBP-3 derived peptides having anti-inflammatory, proapoptotic, anti-angiogenic, cardiovascular, metal-binding, ECM-binding, cell internalization, protease inhibitory, transcription inhibitory, and other activity. IGFBP-3 having altered protease resistance and nuclear localization have also been disclosed.

For example, since the IGFBP-3 precursor variants of the present invention lack the Thyroglobulin type-1 repeat IPR000716 of the WT IGFBP-3 protein (GenBank Accession No. P17936, SEQ ID NO:647), the new IGFBP-3 variants of the present invention might function as an IGF inhibitor.

The IGFBP-3 variants of the present invention can also interfere with the binding of IGF to IGF receptors by increased or diminished affinity to IGF. Thus, the new variants of IGFBP-3 precursor of the present invention can be used as IGF agonists and antagonists for the treatment of musculoskeletal, cancer, inflammatory, endocrine, wound healing, and tissue proliferative conditions. Further, the IGFBP-3 precursor variants, and the polynucleotides encoding same, can be used in the treatment of inborn errors of metabolism, such as dwarfism, via, for example, transient or stable expression of a polynucleotide encoding one or more IGFBP-3 precursor variants in a subject in need thereof.

Thus, the present inventors have uncovered therapeutic agents, polypeptide homologous to SEQ ID NOs:285 and 287 and/or an expressible polynucleotide homologous to SEQ ID NO:286 and 288 and/or a peptide homologous to SEQ ID NO:659 or 660, which can be used to treat a variety of IGFBP-3 and IGF-related conditions, such as all musculoskeletal disorders, amyotrophic lateral sclerosis (ALS), burns, cachexia, cancers of all types, Type I and Type II diabetes, dwarfism, Growth hormone (GH) deficiency, hormone replacement therapy (HRT), general neuropathy, osteoporosis, bone regeneration, wound healing, psoriasis, cerebral ischaemia, prostate and breast cancer, sexual dysfunction, neurological and opthalmalogical disorders, and for selection and breeding of livestock. Since WT IGFBP-3 is the key protein in regulation of circulating IGF levels, important for all cell growth in development and adult life, IGFBP-3 precursor variants such as S56205_P7 (SEQ ID NO:285) and S56205_P15 (SEQ ID NO:287), which can act as agonists and/or antagonists of IGFBP-3 and IGF activity can be useful in upregulating or downregulating a variety of growth and IGF related conditions, such as ALS, autoimmune disease and renal function. The new IGFBP-3 variants of the present invention can also be used to produce novel anti-IGFBP-3 antibodies which can be used for in-vivo therapy of IGFBP-3 and IGF-related disorders and as antagonists and/or agonists of specific IGF and IGFBP-3-related receptor(s), and as diagnostic tools for proliferation of tissue, preferably musculoskeletal tissues, or as a marker for pathological de-differentiation or tissue damage in all systems.

It will be appreciated that such agents can be administered or provided to an individual in need thereof per se or as part of a pharmaceutical composition with a pharmaceutical acceptable carrier (e.g., PEG and liposomes). One preferred method of administration of variant IGFBP-3 polypeptides and/or polynucleotides expressing same, of the present invention, is intravenous administration.

It will be appreciated that the new IGFBP-3 precursor variants of the present invention can be used as a marker for proliferative disorders of tissues, preferably of the musculoskeletal system, such as growth, sarcomas and bone cancer, or as a marker for pathological de-differentiation and/or tissue damage in all tissues. Diagnosis according to this aspect of the present invention is effected using immunological assays [e.g., Western Blot, immunohistochemistry, FACS analysis, radio immuno assay (RIA), immunofluorescence, and the like using an antibody directed against the IGFBP-3 precursor variants [S56205_P7 edited protein (SEQ ID NO:285) and/or S56205_P15 (SEQ ID NO:287)], or by nucleic acid techniques (NAT) such as RT-PCR, Northern Blot, in situ hybridization, in situ RT-PCR.

Example 44

Splice Variant of Renin-Binding Protein

Background

N-acylglucosamine 2-epimerase (GlcNAc 2-epimerase; N-acetyl-D-glucosamine 2-epimerase; Renin-binding protein; RNBP; GenBank Accession No. P51606; RNBP_HUMAN (SEQ ID NO:648) is a bifunctional enzyme critical to the synthesis of sialic acid groups. Sialic acids are widely expressed as terminal carbohydrates on glycoconjugates of eukaryotic cells. Sialylation is crucial for a variety of cellular functions, such as cell adhesion or signal recognition, and regulates the biological stability of glycoproteins. The key enzyme of sialic acid biosynthesis is the bifunctional UDP-N-acetylglucosamine-2-epimerase/N-acetylmannosamine kinase (UDP-GlcNAc 2-epimerase), which catalyzes the first two steps of sialic acid biosynthesis in the cytosol. It has been reported that inactivation of the UDP-GlcNAc 2-epimerase by gene targeting causes early embryonic lethality in mice, thereby emphasizing the fundamental role of this bifunctional enzyme and sialylation during development.

N-Acetylneuraminic acid (NeuAc) is an important molecule in biological recognition systems. NeuAc is known to be biosynthesized either from UDP-N-acetyl-D-glucosamine by an action of UDP-N-acetyl-D-glucosamine 2-epimerase or from N-acetyl-D-glucosamine by N-acyl-D-glucosamine 2-epimerase (GlcNAc 2-epimerase). The GlcNAc 2-epimerase enzyme and its gene were isolated. Sequence analysis indicated that the gene was capable of synthesizing a 46.5-kDa protein (402 amino acids) with a conserved leucine zipper motif. Homology search for the cloned gene revealed that the GlcNAc 2-epimerase was identical with renin-binding protein (RnBP) in porcine kidney (Inoue, H., Fukui, K., Takahashi, S., and Miyake, Y. (1990) J. Biol. Chem. 265, 6556-6561). Targeted mutagenesis revealed that residue Cys 380 is essential for enzymatic activity of the GlcNAc 2-epimerase. Further mutational analysis of multi-cysteine/serine mutants revealed that cysteines 41 and 390 were critical for the activity or stabilization of the enzyme, while cysteine residues in the middle of the enzyme, cysteines 125, 210, 239, and 302, had no essential function in relation to the activity. Studies with recombinant GlcNAc 2-epimerase have revealed that the middle domain of the GlcNAc 2-epimerase molecule participates in the specificity for and binding of nucleotides, and that nucleotides are essential to form the catalytic domain of the enzyme. GlcNAc 2-epimerase can serve a catabolic role, diverting metabolic flux away from the sialic acid pathway.

The causative molecular defect in the inborn human disease sialuria, is a single amino-acid substitution in the region of the allosteric site (codons 263-266), causing a loss of feedback inhibition by CMP-Neu5Ac), resulting in overproduction of ManNAc, thereby competitively excluding Man-Lev from the pathway and abolishing SiaLev expression on the cell surface. Because flux of the natural substrate, ManNAc, continues through the pathway, there is no change in cell-surface glycan expression in the absence of ManLev. Only three mutations have been characterized from human patients, because the disease is rare.

Sialuria is characterized by variable and transient signs and symptoms, especially in infancy. These include prolonged neonatal jaundice, equivocal or mild hepatomegaly and general organomegaly, coarse facial features, microcytic anemia, frequent upper respiratory infections, and episodes of gastroenteritis sometimes leading to failure to thrive. Mild developmental delay and hypotonia have been reported. Learning difficulty and seizures have been observed later in childhood. Mutations in the GNE gene specifically affecting one of a small number of adjacent nucleotides encoding the putative allosteric site in UDP-GlcNAc 2-epimerase/ManNac kinase, the bifunctional rate-limiting enzyme in the biosynthesis pathway of sialic acid, can be detected by mutation scanning and/or sequence analysis.

Splice Variants HUMREBP_T1 (SEQ ID NO:290), HUMREBP_Skippingexon_10_T (SEQ ID NO:292), HUMREBP_T4 (SEQ ID NO:294), HUMREBP_T5 (SEQ ID NO:296), and HUMREBP_T5 (SEQ ID NO:298) Encode New Secreted Forms of N-acylglucosamine 2-epimerase (GlcNAc 2-epimerase): HUMREBP_P2 (SEQ ID NO:289), HUMREBP_Skippingexon_P_P (SEQ ID NO:291), HUMREBP_P3 (SEQ ID NO:293), HUMREBP_P4 (SEQ ID NO:295), and HUMREBP_P1 (SEQ ID NO:297), Respectively.

HUMREBP_P2 (SEQ ID NO:289)

The present inventors have uncovered a new GlcNAc 2-epimerase variant [HUMREBP_P2—SEQ ID NO:289, HUMREBP_T1—SEQ ID NO:290). The protein coordinates on the transcript start from nucleotide 201 and end at nucleotide 1265, as set forth in SEQ ID NO: 290.

Alignment of the new GlcNAc-2 epimerase variant [HUMREBP_P2—SEQ ID NO:289] with the WT N-acylglucosamine 2-epimerase (GenBank Accession No. P51606; SEQ ID NO:648), as shown in FIG. 127, revealed that the interpro domain N-acylglucosamine 2-epimerase (GlcNAc 2-epimerase) IPR008928 and IPR010819 are missing. The new variant uncovered by the present invention is expected to be a secreted, extracellular protein having endopeptidase inhibitor activity, isomerase activity, and rennin binding activity, useful as a cardiostimulant, antihypertensive, peripheral vasodilator, antihypertensive, and further as stimulant of the renin system, and a hypertensive agent (blood pressure stimulator) (CPR).

Comparison Report Between HUMREBP_P2 (SEQ ID NO:289) and RNBP_HUMAN (SEQ ID NO:648)

1. An isolated chimeric polypeptide HUMREBP_P2, comprising a first amino acid sequence being at least 90% homologous to MEKERETLQAWKERVGQELDRVVAF-WMEHSHDQEHGGFFTCLGREGRVYD DLKYVWLQGRQVWMYCRLYRTFER-FRHAQLLDAAKAGGEFLLRYARVAPP GKKCAFVL-TRDGRPVKVQRTIFSECFYTMAMNEL-WRATGEVRYQTEAVEM
MDQIVHWVQEDASGLGRPQLQGAPAAEP-MAVPMMLLNLVEQLGEADEELA GKYAELGDWCAR-RILQHVQRDGQAVLENVSEGGKELPG-CLGRQQNPGHTLE
AGWFLLRHCIRKGDPELRAHVIDKFLLL-PFHSGWDPDHGGLFYFQDADNFCP TQLEWAMKLW-WPHSEAMIAFLMGYSDSGDPVLLRLFYQVAEYTFRQ corresponding to amino acids 1-349 of RNBP_HUMAN, which also corresponds to amino acids 1-349 of HUMREBP_P2, and a second amino acid sequence being at least 70%, optionally at least 80%, preferably at least 85%, more preferably at least 90% and most preferably at least 95% homologous to a polypeptide having the sequence GLYRPG (SEQ ID NO:661) corresponding to amino acids 350-355 of HUMREBP_P2, wherein said first amino acid sequence and second amino acid sequence are contiguous and in a sequential order.

2. An isolated polypeptide for a tail of HUMREBP_P2, comprising a polypeptide being at least 70%, optionally at least about 80%, preferably at least about 85%, more preferably at least about 90% and most preferably at least about 95% homologous to the sequence GLYRPG in HUMREBP_P2.

HUMREB Skipping exon_10_P (SEQ ID NO:291),

The present inventors have uncovered a new GlcNAc 2-epimerase variant [HUMREBP Skippingexon_10_P—SEQ ID NO:291, HUMREBP Skippingexon 10_T—SEQ ID NO:292. The protein coordinates on the transcript start from nucleotide 1 and end at nucleotide 1072, as set forth in SEQ ID NO: 292.

Alignment of the new GlcNAc-2 epimerase variant [HUMREBP Skippingexon_10_P2—SEQ ID NO:2911 with the WT N-acylglucosamine 2-epimerase (GenBank Accession No. P51606; SEQ ID NO:648), as shown in FIG. 128, revealed that the interpro domain N-acylglucosamine 2-epimerase (GlcNAc 2-epimerase) IPR008928 and IPR010819 are missing. The new variant uncovered by the present invention is expected to be a secreted, extracellular protein having endopeptidase inhibitor activity, isomerase activity, and rennin binding activity, useful as a cardiostimulant; antihypertensive; peripheral vasodilator, antihypertensive, and further as stimulant of the renin system, and a hypertensive agent (blood pressure stimulator) (CPR).

Comparison Report Between HUMREBP_Skippingexon_10_P (SEQ ID NO:291) and RNBP_HUMAN (SEQ ID NO:648)

1. An isolated chimeric polypeptide HUMREBP_Skippingexon_10_P, comprising a first amino acid sequence being at least 90% homologous to MEKERETLQAWK-ERVGQELDRVVAFWMEHSHDQEHGGFFT-CLGREGRVYD DLKYVWLQGRQVWMYCRLYRT-FERFRHAQLLDAAKAGGEFLLRYARVAPP GKKCAFVLTRDGRPVKVQRTIFSECFYT-MAMNELWRATGEVRYQTEAVEM MDQIVHWVQE-DASGLGRPQLQGAPAAEPMAVPMMLLN-LVEQLGEADEELA
GKYAELGDWCARRILQHVQRDGQAVLEN-VSEGGKELPGCLGRQQNPGHTLE AGWFLLRHCIR-KGDPELRAHVIDKFLLLPFHSGWDPDHG-GLFYFQDADNFCP
TQLEWAMKLWWPHSEAMIAFLMGYSDS-GDPVLLRLFYQVAEYTFRQ corresponding to amino acids 1-349 of RNBP_HUMAN, which also corresponds to amino acids 1-349 of HUMREBP_Skippingexon_10_P, and a second amino acid sequence being at least 70%, optionally at least 80%, preferably at least 85%, more preferably at least 90% and most preferably at least 95% homologous to a polypeptide having the sequence AASTCRGA (SEQ ID NO:662) corresponding to amino acids 350-357 of HUMREBP_Skippingexon_10_P, wherein said first amino acid sequence and second amino acid sequence are contiguous and in a sequential order.

2. An isolated polypeptide for a tail of HUMREBP_Skippingexon_10_P, comprising a polypeptide being at least 70%, optionally at least about 80%, preferably at least about 85%, more preferably at least about 90% and most preferably at least about 95% homologous to the sequence AASTCRGA in HUMREBP_Skippingexon_10_P.

HUMREB_P3 (SEQ ID NO:293)

The present inventors have uncovered a new GlcNAc 2-epimerase variant [HUMREBP_P3—SEQ ID NO:293, HUMREBP_T4—SEQ ID NO:294. The protein coordinates on the transcript start from nucleotide 201 and end at nucleotide 877, as set forth in SEQ ID NO: 294.

Alignment of the new GlcNAc-2 epimerase variant [HUMREBP_P3—SEQ ID NO:2931 with the WT N-acylglucosamine 2-epimerase (GenBank Accession No. P51606; SEQ ID NO:648), as shown in FIG. 129, revealed that the interpro domain N-acylglucosamine 2-epimerase (GlcNAc 2-epimerase) IPR008928 and IPR010819 are missing. The new variant uncovered by the present invention is expected to be a secreted, extracellular protein having endopeptidase inhibitor activity, isomerase activity, and rennin binding activity, useful as a cardiostimulant; antihypertensive; peripheral vasodilator, antihypertensive, and further as stimulant of the renin system, and a hypertensive agent (blood pressure stimulator) (CPR).

Comparison Report Between HUMREBP_P3 (SEQ ID NO:293) and RNBP_HUMAN (SEQ ID NO:648)

1. An isolated chimeric polypeptide HUMREBP_P3, comprising a first amino acid sequence being at least 90% homologous to MEKERETLQAWKERVGQELDRVVAF-WMEHSHDQEHGGFFTCLGREGRVYD DLKYVWLQGRQVWMYCRLYRTFER-FRHAQLLDAAKAGGEFLLRYARVAPP GKKCAFVL-TRDGRPVKVQRTIFSECFYTMAMNEL-WRATGEVRYQTEAVEM MDQIVHWVQEDASGLGRPQLQGAPAAEP-MAVPMMLLNLVEQLGEADEELA GKYAELGDWCAR-RILQHVQ corresponding to amino acids 1-219 of RNB-P_HUMAN, which also corresponds to amino acids 1-219 of HUMREBP_P3, and a second amino acid sequence being at least 70%, optionally at least 80%, preferably at least 85%, more preferably at least 90% and most preferably at least 95% homologous to a polypeptide having the sequence ARAGRGGSCL (SEQ ID NO:663) corresponding to amino acids 220-229 of HUMREBP_P3, wherein said first amino acid sequence and second amino acid sequence are contiguous and in a sequential order.

2. An isolated polypeptide for a tail of HUMREBP_P3, comprising a polypeptide being at least 70%, optionally at least about 80%, preferably at least about 85%, more preferably at least about 90% and most preferably at least about 95% homologous to the sequence ARAGRGGSCL in HUMREBP_P3.

HUMREB_P4 (SEQ ID NO:295)

The present inventors have uncovered a new GlcNAc 2-epimerase variant [HUMREBP_P4—SEQ ID NO:295, HUMREBP_T5—SEQ ID NO:296. The protein coordinates on the transcript start from nucleotide 201 and end at nucleotide 877, as set forth in SEQ ID NO: 296.

Alignment of the new GlcNAc-2 epimerase variant [HUMREBP_P4 (SEQ ID NO:295)] with the WT N-acylglucosamine 2-epimerase (GenBank Accession No. P51606; SEQ ID NO:648), as shown in FIG. 130, revealed that the interpro domain N-acylglucosamine 2-epimerase (GlcNAc 2-epimerase) IPR008928 and IPR010819 are missing. The new variant uncovered by the present invention is expected to be a secreted, extracellular protein having endopeptidase inhibitor activity, isomerase activity, and rennin binding activity, useful as a cardiostimulant; antihypertensive; peripheral vasodilator, antihypertensive, and further as stimulant of the renin system, and a hypertensive agent (blood pressure stimulator) (CPR).

Comparison Report Between HUMREBP_P4 (SEQ ID NO:295) and RNBP_HUMAN (SEQ ID NO:648)

1. An isolated chimeric polypeptide HUMREBP_P4, comprising a first amino acid sequence being at least 90% homologous to MEKERETLQAWKERVGQELDRVVAF-WMEHSHDQEHGGFFTCLGREGRVYD DLKYVWLQGRQVWMYCRLYRTFER-FRHAQLLDAAKAGGEFLLRYARVAPP GKKCAFVL-TRDGRPVKVQRTIFSECFYTMAMNELWRATGEVRY corresponding to amino acids 1-143 of RNBP_HUMAN, which also corresponds to amino acids 1-143 of HUMREBP_P4, a second amino acid sequence being at least 90% homologous to QEDASGLGRPQLQGAPAAEPMAVPM-MLLNLVEQLGEADEELAGKYAELGD WCAR-RILQHVQ corresponding to amino acids 159-219 of RNB-P_HUMAN, which also corresponds to amino acids 144-204 of HUMREBP_P4, and a third amino acid sequence being at least 70%, optionally at least 80%, preferably at least 85%, more preferably at least 90% and most preferably at least 95% homologous to a polypeptide having the sequence ATR-WKPAGFCSVIAFGKATPNFEPT corresponding to amino acids 205-229 of HUMREBP_P4, wherein said first amino acid sequence, second amino acid sequence and third amino acid sequence are contiguous and in a sequential order.

2. An isolated chimeric edge portion of HUMREBP_P4, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise YQ, having a structure as follows: a sequence starting from any of amino acid numbers 143-x to 143; and ending at any of amino acid numbers 144+((n−2)−x), in which x varies from 0 to n−2.

3. An isolated polypeptide for a tail of HUMREBP_P4, comprising a polypeptide being at least 70%, optionally at least about 80%, preferably at least about 85%, more preferably at least about 90% and most preferably at least about 95% homologous to the sequence ATRWKPAGFCSVIAF-GKATPNFEPT in HUMREBP_P4.

HUMREB_P1 (SEQ ID NO:297),

The present inventors have uncovered a new GlcNAc 2-epimerase variant [HUMREBP_P1—SEQ ID NO:297, HUMREBP_T2—SEQ ID NO:298. The protein coordinates on the transcript start from nucleotide 201 and end at nucleotide 1553, as set forth in SEQ ID NO: 298.

Alignment of the new GlcNAc-2 epimerase variant [HUMREBP_P1—SEQ ID NO:2971 with the WT N-acylglucosamine 2-epimerase (GenBank Accession No. P51606; SEQ ID NO:648), as shown in FIG. 131, revealed that the interpro domain N-acylglucosamine 2-epimerase (GlcNAc 2-epimerase) IPR008928 and IPR010819 are missing. The new variant uncovered by the present invention is expected to be a secreted, extracellular protein having endopeptidase inhibitor activity, isomerase activity, and rennin binding activity, useful as a cardiostimulant; antihypertensive;

peripheral vasodilator, antihypertensive, and further as stimulant of the renin system, and a hypertensive agent (blood pressure stimulator) (CPR).

Comparison Report Between HUMREBP_P1 (SEQ ID NO:297) and RNBP_HUMAN (SEQ ID NO:648)

1. An isolated chimeric polypeptide HUMREBP_P1, comprising a first amino acid sequence being at least 90% homologous to MEKERETLQAWKERVGQELDRVVAF-WMEHSHDQEHGGFFTCLGREGRVYD DLKYVWLQGRQVWMYCRLYRTFER-FRHAQLLDAAKAGGEFLLRYARVAPP GKKCAFVL-TRDGRPVKVQRTIFSECFYTMAMNEL-WRATGEVRYQTEAVEM MDQIVHWVQEDASGLGRPQLQGAPAAEP-MAVPMMLLNLVEQLGEADEELA GKYAELGDWCAR-RILQHVQRDGQAVLENVSEGGKELPG-CLGRQQNPGHTLE AGWFLLRHCIRKGDPELRAHVIDKFLLL-PFHSGWDPDHGGLFYFQDADNFCP TQLEWAMKLW-WPHSEAMIAFLMGYSDSGDPVLLRLFYQVAEYTFR corresponding to amino acids 1-348 of RNBP_HUMAN, which also corresponds to amino acids 1-348 of HUMREBP_P1, a second amino acid sequence being at least 70%, optionally at least 80%, preferably at least 85%, more preferably at least 90% and most preferably at least 95% homologous to a polypeptide having the sequence QAGAQWRDLSSLQPPPPVFKLFSRLSLPSILLGL (SEQ ID NO:664) corresponding to amino acids 349-382 of HUMREBP_P1, and a third amino acid sequence being at least 90% homologous to QFRDPEYGEWFGYLSREGKVAL-SIKGGPFKGCFHVPRCLAMCEEMLGALLSR PAPAPS-PAPTPACRGAE corresponding to amino acids 349-417 of RNBP_HUMAN, which also corresponds to amino acids 383-451 of HUMREBP_P1, wherein said first amino acid sequence, second amino acid sequence and third amino acid sequence are contiguous and in a sequential order.

2. An isolated edge portion of HUMREBP_P1, comprising an amino acid sequence being at least 70%, optionally at least about 80%, preferably at least about 85%, more preferably at least about 90% and most preferably at least about 95% homologous to the sequence encoding for QAGAQWRDLSSLQPPPPVFKLFSRLSLPSILLGL, corresponding to HUMREBP_P1.

Clinical Applications of the N-acylglucosamine 2-epimerase (GlcNAc 2-epimerase) Variant of the Present Invention Since the N-acylglucosamine 2-epimerase (GlcNAc 2-epimerase) variants of the present invention lack the IPR008928 and IPR010819 domains of the WT N-acylglucosamine 2-epimerase (GlcNAc 2-epimerase) protein (GenBank Accession No. P51606, SEQ ID NO:648), they can compete with the endogenous N-acylglucosamine 2-epimerase (GlcNAc 2-epimerase) protein and related peptides, and interfere with their various activities. For example, the new N-acylglucosamine 2-epimerase (GlcNAc 2-epimerase) variants of the present invention might inactivate Renin, without performing the reduced N-acylglucosamine 2-epimerase (GlcNAc 2-epimerase) function, and thus can act as a potent renin inhibitor in the renin-angiotensin-aldosterone system, causing reduction in aldosterone and water retention.

The N-acylglucosamine 2-epimerase (GlcNAc 2-epimerase) variants of the present invention can also inactivate (by dominant negative effect) the normal renin binding function of the normal N-acylglucosamine 2-epimerase (GlcNAc 2-epimerase) (RENBP) by heterodimer formation, and thus act as a renin stimulator. Thus, the new variants of N-acylglucosamine 2-epimerase (GlcNAc 2-epimerase) of the present invention can be used as N-acylglucosamine 2-epimerase (GlcNAc 2-epimerase) agonists and antagonists for the treatment of hypertension and other disorders of renal function, as stimulants in cardiac disorders, as peripheral vasodilators, and as a blood pressure stimulator (CPR). Further, the new N-acylglucosamine 2-epimerase (GlcNAc 2-epimerase) variants, and the polynucleotides encoding same, can be used in the treatment of inborn errors of metabolism, such as sialuria, via, for example, transient or stable expression of a polynucleotide encoding one or more N-acylglucosamine 2-epimerase (GlcNAc 2-epimerase) variants in a subject in need thereof.

Thus, the present inventors have uncovered therapeutic agents, polypeptide homologous to SEQ ID NOs:289, 291, 293, 295 and 297 and/or an expressible polynucleotide homologous to SEQ ID NO:290, 292, 294, 296 and 298 which can be used to treat a variety of N-acylglucosamine 2-epimerase (GlcNAc 2-epimerase)-related conditions, such as renal and cardiac disease, hypertension and hypotension (shock), and as a peripheral vasodilator. Since WT N-acylglucosamine 2-epimerase (GlcNAc 2-epimerase) is the key enzyme in the sialylation pathways important for cell adhesion and cell recognition, and for biological stability of glycoproteins, and is considered crucial in embryonic viability, and in the functioning of the renin-angiotensin-aldosterone pathway, N-acylglucosamine 2-epimerase (GlcNAc 2-epimerase) variants such as HUMREBP_T1 (SEQ ID NO:290), HUMREBP_Skippingexon_10_T (SEQ ID NO:292), HUMREBP_T4 (SEQ ID NO:294), HUMREBP_T5 (SEQ ID NO:296), and HUMREBP_T5 (SEQ ID NO:298), which can act as agonists and/or antagonists of N-acylglucosamine 2-epimerase (GlcNAc 2-epimerase) activity can be useful in upregulating or downregulating a variety of N-acylglucosamine 2-epimerase (GlcNAc 2-epimerase) and sialylation-related conditions, such as hypertension and/or cardiac insufficiency. The new N-acylglucosamine 2-epimerase (GlcNAc 2-epimerase) variants of the present invention can also be used to produce novel anti-N-acylglucosamine 2-epimerase (GlcNAc 2-epimerase) antibodies which can be used for in-vivo therapy of N-acylglucosamine 2-epimerase (GlcNAc 2-epimerase)-related disorders and as antagonists and/or agonists of specific N-acylglucosamine 2-epimerase (GlcNAc 2-epimerase)-related receptor(s), and as diagnostic tools for proliferation of skin tissue, or as a marker for pathological de-differentiation or tissue damage in the skin.

It will be appreciated that such agents can be administered or provided to an individual in need thereof per se or as part of a pharmaceutical composition with a pharmaceutical acceptable carrier (e.g., PEG and liposomes). One preferred method of administration of variant N-acylglucosamine 2-epimerase (GlcNAc 2-epimerase) polypeptides and/or polynucleotides expressing same, of the present invention, is intravenous administration.

It will be appreciated that, since the new N-acylglucosamine 2-epimerase (GlcNAc 2-epimerase) variants of the present invention are overexpressed in the skin, the new N-acylglucosamine 2-epimerase (GlcNAc 2-epimerase) variants can be used as a marker for proliferative disorders of the skin, such as psoriasis and keloids, or as a marker for pathological de-differentiation and/or tissue damage in the skin. Diagnosis according to this aspect of the present invention is effected using immunological assays [e.g., Western Blot, immunohistochemistry, FACS analysis, radio immuno assay (RIA), immunofluorescence, and the like using an antibody directed against the N-acylglucosamine 2-epimerase (GlcNAc 2-epimerase) variants (SEQ ID NO:289, 291, 293, 295, or 297], or by nucleic acid techniques (NAT) such as RT-PCR, Northern Blot, in situ hybridization, in situ RT-PCR.

Example 45

Splice Variant of Hepatocyte Growth Factor Precursor

Background

Hepatocyte growth factor precursor (Scatter factor; SF; Hepatopoeitin A; GenBank Accession No. P14210; HGF_HUMAN (SEQ ID NO:649); HGF precursor) is cleaved into HGF, a mesenchyme-derived pleiotropic factor, which regulates cell growth, cell motility, and morphogenesis of various types of cells and is thus considered a humoral mediator of epithelial-mesenchymal interactions responsible for morphogenic tissue interactions during embryonic development and organogenesis.

Growing evidence indicates that HGF is also an endogenous renoprotective factor that possesses a potent antifibrotic ability. HGF prevents the initiation and progression of chronic renal fibrosis and inhibits transforming growth factor (TGF)-beta(1) expression in a wide variety of animal models, and can be used for inhibition of renal fibrosis.

Although HGF was originally identified as a potent mitogen for hepatocytes, it has also been identified as a member of angiogenic growth factors. Interestingly, the presence of its specific receptor, c-met, is also observed in vascular cells and cardiac myocytes. Among growth factors, the mitogenic action of HGF on human endothelial cells was most potent. Recent studies have demonstrated the potential application of HGF to treat cardiovascular diseases such as peripheral vascular disease, myocardial infarction and cerebrovascular disease.

HGF polypeptides are able to induce a variety of biological effects besides cell proliferation. The main biological activities of these molecules are: stimulation of cell division (mitogenesis); stimulation of motility (scattering); induction of polarisation and cell differentiation; induction of tubule formation (branched morphogenesis), increase of cell survival (protection from apoptosis). The tissues that respond to HGF and MSP stimulation are those containing cells that express the respective Met (HGF) and Ron (MSP) receptors. The most important target tissues of these factors are epithelia of different organs, such as liver, kidney, lung, breast, pancreas and stomach, and some cells of the hematopoietic and nervous systems.

Examples of the therapeutic and diagnostic use of HGF and agonists and antagonists of HGF and HGF receptor abound. Schwall et al (U.S. Pat. Nos. 6,214,344 and 6,207,152) teach the use of anti HGF mAbs and HGF receptor agonists for the treatment of cancer (breast, lung, prostate, colon, pancreatic, lung cancer); Morishita et al (U.S. Pat. No. 6,248,722) teach the use of HGF for treatment of arterial disease. U.S. Pat. No. 6,319,899 teaches the use of specific domains of HGF for the stimulation of mitogenesis and motility, induction of cell polarization and differentiation, morphogenesis and increased cell survival in the epithelia of organs such as liver, kidney, lung, breast, pancreas, stomach, and cells of the hematopoietic and nervous systems. US Patent Application 0040138120 to Kirchhofer et al teaches HGF precursor polypeptides having novel kallekrein or FXIa cleavage sites for generation of HGF variants or fragments for the treatment of a wide variety of cancer and inflammatory diseases.

Splice Variants HSHGFR_Skipping_exon_3_T (SEQ ID NO:300), HSHGFR_Skipping_exon_4_T (SEQ ID NO:302), HSHGFR_Skipping_exon_7_T (SEQ ID NO:304) and HSHGFR_Skipping_exon_9_T (SEQ ID NO:306) Encode New Secreted Forms of Hepatocyte Growth Factor (HGF) Precursor HSHGFR_Skipping_exon_3_P (SEQ ID NO:299), HSHGFR_Skipping_exon_4_P (SEQ ID NO:301), HSHGFR_Skipping_exon_7_P (SEQ ID NO:303) and HSHGFR_Skipping_exon_9_P (SEQ ID NO:305, Respectively).

HSHGFR_Skipping_exon_3_P

The present inventors have uncovered a new Hepatocyte Growth Factor precursor variant [HSHGFR_Skippingexon_3_P—SEQ ID NO:299, HSHGFR_Skippingexon_3_T—SEQ ID NO:3001. The protein coordinates on the transcript start from nucleotide 168 and end at nucleotide 428, as set forth in SEQ ID NO: 300.

Figure 20:
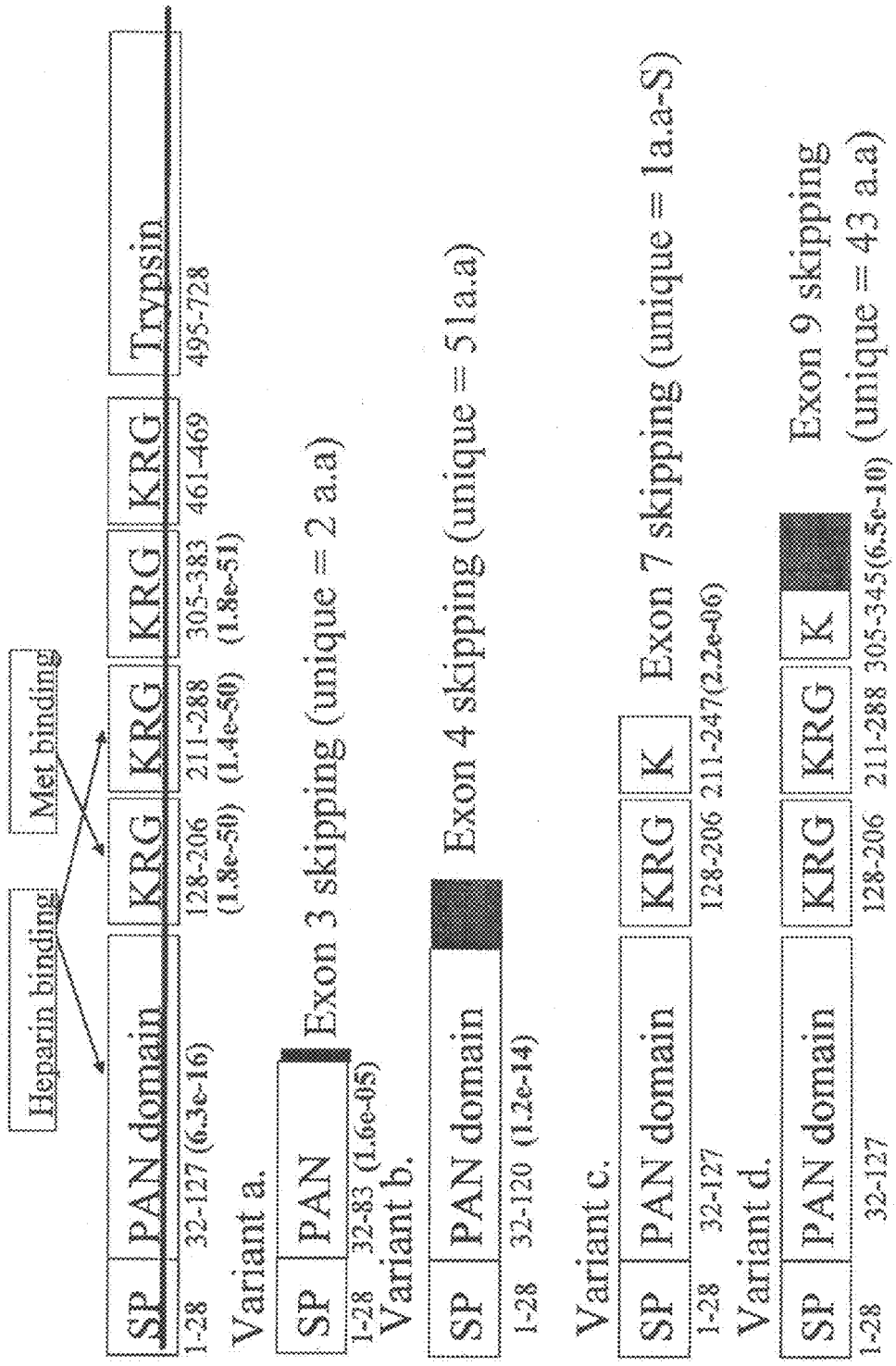
FIG. 20 is a schematic illustration showing the protein domain structure of wild-type HGF protein (SwissProt locus: HGF_HUMAN; GenBank Accession No. P14210; SEQ ID NO:133) and the HGF variants of the present invention, as described in Example 45a-d below. The novel splice variants are as follows: Variant a: skipping exon 3; Variant b: skipping exon 4; Variant c: skipping exon 7; and Variant d: skipping exon 9.

Alignment of the new HGF precursor variant [HSHGFR_Skippingexon_3_P—SEQ ID NO:2991 with the WT HGF precursor protein [GenBank Accession No. P14210; HGF_HUMAN—SEQ ID NO:6491, as shown in FIGS. 132 and 20a, revealed that the interpro domain IPR001254—Trypsin, four kringle domains—IPR000001 (amino acids 126-207, 208-289, 302-384 and 388-470 of GenBank Accession No. P14210, SEQ ID NO:649) and a PAN domain—IPR003014 or IPR003609 are missing in the new variant. The new variant contains a SP IPR003609 (amino acids 1-28 of GenBank Accession No. P14210, SEQ ID NO:649) and a reduced PAN domain—IPR003609 (amino acids 32-83 of GenBank Accession No. P14210, SEQ ID NO:649), and 2 unique amino acids. The new variant uncovered by the present invention is expected to be a secreted, extracellular protein having HGF receptor binding and MET protooncogene receptor antagonist activity.

Comparison Report Between HSHGFR_Skipping_exon_3_P and HGF_HUMAN (SEQ ID NO:649)

1. An isolated chimeric polypeptide HSHGFR_Skipping_exon_3_P, comprising a first amino acid sequence being at least 90% homologous to MWVTKLLPALLLQH-VLLHLLLLPIAIPYAEGQRKRRNTI-HEFKKSAKTTLIKID PALKIKTKKVNTADQCANRC-TRNKGLPFTCK corresponding to amino acids 1-85 of HGF_HUMAN, which also corresponds to amino acids 1-85 of HSHGFR_Skipping_exon_3_P, and a second amino acid sequence being at least 70%, optionally at least 80%, preferably at least 85%, more preferably at least 90% and most preferably at least 95% homologous to a polypeptide having the sequence LH corresponding to amino acids 86-87 of HSHGFR_Skipping_exon_3_P, wherein said first amino acid sequence and second amino acid sequence are contiguous and in a sequential order.

HSHGFR_Skipping_exon_4_P

The present inventors have uncovered a new Hepatocyte Growth Factor precursor variant [HSHGFR_Skippingexon_4_P—SEQ ID NO:301, HSHGFR_Skippingexon_4_T—SEQ ID NO:302]. The protein coordinates on the transcript start from nucleotide 168 and end at nucleotide 686, as set forth in SEQ ID NO: 302.

Alignment of the new HGF precursor variant [HSHGFR_Skippingexon_4_P—SEQ ID NO:3011 with the WT HGF precursor protein [GenBank Accession No. P14210—SEQ ID NO:649, as shown in FIGS. 133 and 20b, revealed that the interpro domain IPR001254—Trypsin, four kringle domains—IPR000001 (amino acids 126-207, 208-289, 302-384 and 388-470 of GenBank Accession No. P14210, SEQ ID NO:649) and a PAN domain—IPR003014 or IPR003609 are missing in the new variant. The new variant contains a SP IPR003609 (amino acids 1-28 of GenBank Accession No. P14210, SEQ ID NO:649) and a reduced PAN domain—IPR003609 (amino acids 32-120 of GenBank Accession No. P14210, SEQ ID NO: 649), and 51 unique amino acids. The new variant uncovered by the present invention is expected to be a secreted, extracellular protein having HGF receptor binding and MET protooncogene receptor antagonist activity.

Comparison Report Between HSHGFR_Skipping_exon_4_P and HGF_HUMAN

1. An isolated chimeric polypeptide HSHGFR_Skipping_exon_4_P, comprising a first amino acid sequence being at least 90% homologous to MWVTKLLPALLLQH-VLLHLLLLPIAIPYAEGQRKRRNTI-HEFKKSAKTTLIKID PALKIKTKKVNTADQCANRC-TRNKGLPFTCKAFVFDKARKQCLWFPFNSMSS GVKKEFGHEFDLYENK corresponding to amino acids 1-122 of HGF_HUMAN, which also corresponds to amino acids 1-122 of HSHGFR_Skipping_exon_4_P, and a second amino acid sequence being at least 70%, optionally at least 80%, preferably at least 85%, more preferably at least 90% and most preferably at least 95% homologous to a polypeptide having the sequence AFCLRAIGVKTYRKTTVEI-LEGKKGDPGVSQAIQRYATKSVTFLSVQKLNA (SEQ ID NO:665) corresponding to amino acids 123-173 of HSHGFR_Skipping_exon_4_P, wherein said first amino acid sequence and second amino acid sequence are contiguous and in a sequential order.

2. An isolated polypeptide for a tail of HSHGFR_Skipping_exon_4_P, comprising a polypeptide being at least 70%, optionally at least about 80%, preferably at least about 85%, more preferably at least about 90% and most preferably at least about 95% homologous to the sequence AFCLRAIGVKTYRKTTVEILEGKKGD-PGVSQAIQRYATKSVTFLSVQKLNA in HSHGFR_Skipping_exon_4_P.

HSHGFR_Skipping_exon_7_P

The present inventors have uncovered a new Hepatocyte Growth Factor precursor variant [HSHGFR_Skippingexon_7_P—SEQ ID NO:303, HSHGFR_Skippingexon_7_T—SEQ ID NO:304]. The protein coordinates on the transcript start from nucleotide 168 and end at nucleotide 941, as set forth in SEQ ID NO: 304.

Alignment of the new HGF precursor variant [HSHGFR_Skippingexon_7_P—SEQ ID NO:303] with the WT HGF precursor protein [HGF_HUMAN—SEQ ID NO:649], as shown in FIGS. 20c and 134, revealed that the interpro domain IPR001254—Trypsin and three kringle domains—IPR000001 are missing in the new variant. The new variant contains a SP IPR003609 (amino acids 1-28 of GenBank Accession No. P14210, SEQ ID NO:649) a PAN domain—IPR003609 (amino acids 32-127 of GenBank Accession No. P14210, SEQ ID NO:649), one full Kringle IPR000001 domain (amino acids 128-206 of GenBank Accession No. P14210, SEQ ID NO: 649) and a portion of a second Kringle IPR000001 domain (amino acids 211-247 of GenBank Accession No. P14210, SEQ ID NO:649). The new variant has a single unique amino acid. The new variant uncovered by the present invention is expected to be a secreted, extracellular protein having HGF receptor binding and MET protooncogene receptor antagonist activity, MET inhibitor, anticancer, anti-proliferative activity. The new variant is expected to be a partial agonist of MET (much like the NK2 known variant—antagonizing growth but facilitates metastasis), a hepatoprotective agent and a proliferative agent (wound healing).

Comparison Report Between HSHGFR_Skipping_exon_7_P and HGF_HUMAN

1. An isolated chimeric polypeptide HSHGFR_Skipping_exon_7_P, comprising a first amino acid sequence being at least 90% homologous to MWVTKLLPALLLQH-VLLHLLLLPIAIPYAEGQRKRRNTI-HEFKKSAKTTLIKID PALKIKTKKVNTADQCANRC-TRNKGLPFTCKAFVFDKARKQCLWFPFNSMSS GVKKEFGHEFDLYENKDYIRNCI-IGKGRSYKGTVSITKSGIKCQPWSSMIPHEH SFLPSSYRGKDLQENYCRNPRGEEGGP-WCFTSNPEVRYEVCDIPQCSEVECMT CNGESYR-GLMDHTESGKICQRWDHQTPHRHKFLPE corresponding to amino acids 1-248 of HGF_HUMAN, which also corresponds to amino acids 1-248 of HSHGFR_Skipping_exon_7_P, and a second amino acid sequence being at least 70%, optionally at least 80%, preferably at least 85%, more preferably at least 90% and most preferably at least 95% homologous to a polypeptide having the sequence S corresponding to amino acids 249-249 of HSHGFR_Skipping_exon_7_P, wherein said first amino acid sequence and second amino acid sequence are contiguous and in a sequential order.

RT-PCR Validation of the Novel Splice Variant of HGF, Skipping Exon 7

Figure 21:
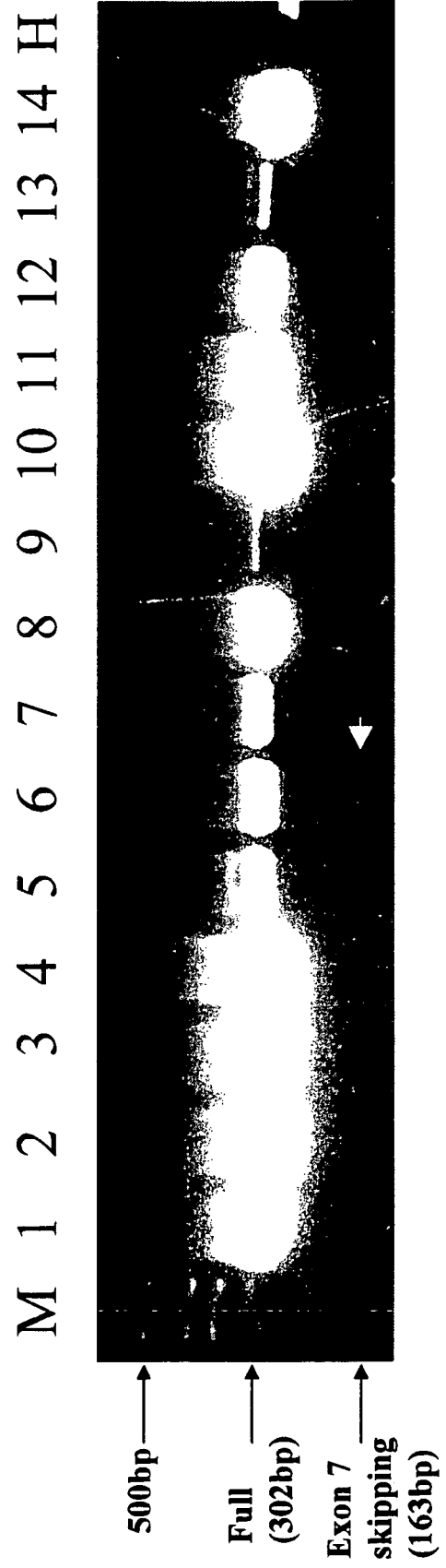
FIG. 21 RT-PCR for identification of exon 7 skipping in Hepatocyte Growth Factor. The protocol used is described in Example 45c-2 of the Examples section which follows. Primers were taken from exon 6 (f) and 8 (r). Predicted product of full length product was 302 bp, which was found in all tissue samples. Skipping exon 7 (163 bp) was found exclusively in Colon (lane 6-arrowhead). A larger product (probably a novel exon) was found in Breast (lane 5). Tissue type cDNA pools: 1—Cervix+HeLa; 2—Uterus; 3—Ovary; 4—Placenta; 5—Breast; 6—Colon; 7—Pancreas; 8—Liver+Spleen; 9—Brain; 10—Prostate; 11—Testis; 12—Kidney; 13—Thyroid; 14—Assorted Cell-lines (5). M=1 kb ladder marker; H=H$_2$O negative control.

While reducing the present invention to practice, tissue samples from various organs were assayed, using RT-PCR, for expression of the novel splice variant of HGF, skipping exon 7. RT-PCR analysis results for identification of the novel exon 7 skipping splice variant of Hepatocyte Growth Factor are shown in FIG. 21. Primers were taken from exon 6 (0 and 8 (r). The predicted product of the full length transcription product was 302 bp, which was found in all tissue samples (FIG. 21). Skipping exon 7 (predicted 163 bp) was found exclusively in samples of Colon tissue (lane 6-arrowhead). A larger product (probably a novel exon) was found in samples of Breast tissue (lane 5). Tissue type cDNA pools: 1—Cervix+HeLa; 2—Uterus; 3—Ovary; 4—Placenta; 5—Breast; 6—Colon; 7—Pancreas; 8—Liver+Spleen; 9—Brain; 10—Prostate; 11—Testis; 12—Kidney; 13—Thyroid; 14—As sorted Cell-lines (5). M=1 kb ladder marker; H=$H_2O$ negative control.

Materials and Experimental Methods

RT-PCR conditions: RT was done on Total RNA samples (see source on mark 9). The reaction was done using random hexamer primer mix (Invitrogen) and Superscript II Reverse transcriptase (Invitrogen).

Conditions:
(i) Denaturation at 70° C. (5 min)
(ii) Annealing on ice
(iii) RT at 37° C. (1 hour).

PCR conditions: For all reactions, "Hot-Star" Taq polymerase (Qiagen) was used.

Some reactions required addition of Q solution (Qiagen) to enhance the reaction.

Reaction Composition:
Total Volume 25 µl
Taq Buffer ×10—2.5 µl
DNTP's (mix of 4) ×12.5—2 µl
Primers—0.5 µl of each (total 1 µl)
cDNA—1 µl
Taq Enzyme—0.5 µl
Q solution (optional) ×5—5 µl
$H_2O$—To add up to 25 µl
Reaction Conditions:

| | |
|---|---|
| 1-Activation of HotStar Taq | 95° C. for 5 min's |
| 2-Denaturation | 94° C. for 45 sec. |
| 3-Annealing | Tm (specific for primer set) - 4-5° C. for 45 sec. |
| 4-Extension | 72° C. for 1 min. |
| 5-Repeat stages 2-4 for 34 more times. | |

| | |
|---|---|
| 6-Gap filling | 72° C. for 10 min's. |
| 7-Storage | 10° C. (indefinitely). |

Reaction product was separated on a 2% agarose gel in TBEx5 at ~150V. DNA was extracted from gel using a Qiaquick (Qiagen) kit, and DNA was used for direct sequencing using the same primers.

Primers used are:

```
Forward:   5' GGATCATCAGACACCACACCGGC 3'    TM = 67
Predicted Product size: 302 bp (183 bp without
exon).
Reverse:   5' CGTGAGGATACTGAGAATCCCAACGC 3' TM = 67
```

Source of the tissue samples used for the RT-PCR:

Sample 1: Cervix pool—A pool of 3 RNA samples of mixed origin from cervical tissue (Tumor and Normal), and samples of mRNA from a HeLa cell-line (cervical cancer).

Sample 2: Uterus pool—A pool of 3 RNA samples of mixed origin from uterine tissue (Tumor and Normal).

Sample 3: Ovary pool—A pool of 5 RNA samples from ovarian tissue (Biochain—Normal), added with two samples of mixed origin (Tumor and Normal).

Sample 4: Placenta—One sample of RNA from placental tissue (Biochain—Normal).

Sample 5: Breast Pool—A pool of 3 RNA samples of breast tissue of mixed origin (2 from tumor and one from normal).

Sample 6: Colon and intestine—A pool of 5 RNA samples of colon and of mix origin (Tumor and Normal), with one intestine (Normal) derived RNA sample.

Sample 7: Pancreas—One sample of RNA of pancreas tissue (Biochain—Normal).

Sample 8: Liver and Spleen—One sample of RNA from liver tissue (Biochain—Normal), one sample of RNA from Spleen tissue (Biochain—Normal), added with—One sample of RNA from HepG2 cell line (Liver tumor).

Sample 9: Brain pool—A pool of RNA samples from brain tissue (Biochain—Normal).

Sample 10: Prostate pool—A pool of RNA samples from prostate tissue (Biochain—Normal).

Sample 11: Testis pool—A pool of RNA samples from Testis (Biochain—Normal).

Sample 12: Kidney pool—A pool of RNA samples from kidney tubules (Biochain—Normal).

Sample 13: Thyroid pool—A pool of RNA samples from thyroid tissue (Biochain—Normal).

Sample 14: Assorted cell-line pool—A pool of RNA samples from cells of the cell-lines: DLD, MiaPaCa, HT29, THP1, MCF7 (ATCC).

HSHGFR_Skipping_exon_9_P

The present inventors have uncovered a new Hepatocyte Growth Factor precursor variant [HSHGFR_Skippingexon_9_P—SEQ ID NO:305, HSHGFR_Skippingexon_9_T—SEQ ID NO:306]. The protein coordinates on the transcript start from nucleotide 168 and end at nucleotide 1337, as set forth in SEQ ID NO: 306.

Alignment of the new HGF precursor variant [HSHGFR_Skippingexon_9_P—SEQ ID NO:305] with the WT HGF precursor protein [GenBank Accession No. P14210; HGF_HUMAN—SEQ ID NO:649], as shown in FIGS. 135 and 20d, revealed that the interpro domain IPR001254—Trypsin and three kringle domains—IPR000001 are missing in the new variant. The new variant contains a SP IPR003609 (amino acids 1-28 of GenBank Accession No. P14210, SEQ ID NO:649) a PAN domain—IPR003609 (amino acids 32-127 of GenBank Accession No. P14210, SEQ ID NO:649), two full Kringle IPR000001 domain (amino acids 128-206 and 211-288 of GenBank Accession No. P14210, SEQ ID NO:649) and a portion of a third Kringle IPR000001 domain (amino acids 305-345 of GenBank Accession No. P14210, SEQ ID NO:649). The new variant has 43 unique amino acids. The new variant uncovered by the present invention is expected to be a secreted, extracellular protein having HGF receptor binding and MET protooncogene receptor antagonist activity, MET inhibitor, anticancer, anti-proliferative activity. The new variant is expected to be a partial agonist of MET (much like the NK2 known variant—antagonizing growth but facilitates metastasis), a hepatoprotective agent and a proliferative agent (wound healing).

Comparison Report Between HSHGFR_Skipping_exon_9_P and HGF_HUMAN

1. An isolated chimeric polypeptide HSHGFR_Skipping_exon_9_P, comprising a first amino acid sequence being at least 90% homologous to MWVTKLLPALLLQH-VLLHLLLLPIAIPYAEGQRKRRNTI-HEFKKSAKTTLIKID PALKIKTKKVNTADQCANRC-TRNKGLPFTCKAFVFDKARKQCLWFPFNSMSS GVKKEFGHEFDLYENKDYIRNCI-IGKGRSYKGTVSITKSGIKCQPWSSMIPHEH SFLPSSYRGKDLQENYCRNPRGEEGGP-WCFTSNPEVRYEVCDIPQCSEVECMT CNGESYR-GLMDHTESGKICQRWDHQTPHRHKFLP-ERYPDKGFDDNYCRNPD GQPRPWCYTLDPHTRWEYCAIKTCADNT-MNDTDVPLETTECIQGQGEGYRG TVNTIWNGIPC-QRWDSQYPHEHDMTPENFKCK corresponding to amino acids 1-347 of HGF_HUMAN, which also corresponds to amino acids 1-347 of HSHGFR_Skipping_exon_9_P, and a second amino acid sequence being at least 70%, optionally at least 80%, preferably at least 85%, more preferably at least 90% and most preferably at least 95% homologous to a polypeptide having the sequence LLSWEWQKLYGQLIP-NKIWTNMFNVGQEHGRLTSSYLLGTRCK (SEQ ID NO:666) corresponding to amino acids 348-390 of HSHG-FR_Skipping_exon_9_P, wherein said first amino acid sequence and second amino acid sequence are contiguous and in a sequential order.

2. An isolated polypeptide for a tail of HSHGFR_Skipping_exon_9_P, comprising a polypeptide being at least 70%, optionally at least about 80%, preferably at least about 85%, more preferably at least about 90% and most preferably at least about 95% homologous to the sequence LLSWEWQKLYGQLIPNKIWTNMFNVGQE-HGRLTSSYLLGTRCK in HSHGFR_Skipping_exon_9_P.

Clinical Applications of the HGF Precursor Variant of the Present Invention

Since the HGF precursor variants of the present invention lack the Trypsin, and significant portions of the Kringle and PAN domains of the WT HGF precursor protein (GenBank Accession No. P14210, SEQ ID NO:649), they can compete with the endogenous HGF precursor protein and related peptides, and interfere with their various activities. For example, the new variants of HGF precursor proteins of the present invention can be used as HGF and HGF receptor agonists and antagonists for the treatment of cancer (breast, lung, prostate, colon, pancreatic, lung cancer), arterial disease, for the stimulation of mitogenesis and motility, induction of cell polarization and differentiation, morphogenesis and increased cell survival in the epithelia of organs such as liver, kidney, lung, breast, pancreas, stomach, and cells of the hematopoietic and nervous systems.

Thus, the present inventors have uncovered therapeutic agents, polypeptide homologous to SEQ ID NOs:299, 301, 303 and 305 and/or an expressible polynucleotide homologous to SEQ ID NO:300, 302, 304 and 306 which can be used to treat a variety of HGF-related conditions, such as hepatic, vascular, gastrointestinal, pulmonary, renal and cardiac disease, hematopoietic and nervous disorders, and cancers of various origins, and their metastatic development. Since HGF and component peptides effect cell growth, cell motility, and morphogenesis of various types of cells and WT HGF is considered a humoral mediator of epithelial-mesenchymal interactions responsible for morphogenic tissue interactions during embryonic development and organogenesis, HGF precursor variants such as HSHGFR_Skippingexon_3_P (SEQ ID NO:299), HSHGFR_Skippingexon_4_P (SEQ ID NO: 301), HSHGFR_Skippingexon_7_P (SEQ ID NO:303) and HSHGFR_Skippingexon_9_P (SEQ ID NO:305), which can act as agonists and/or antagonists of specific HGF receptor(s) can be useful in upregulating or downregulating a variety of HGF-related conditions, such as cancer of the breast, colon, pancreas, etc, and other Met-receptor related malignancies. The new HGF precursor variants of the present invention can also be used to produce novel anti-HGF peptide antibodies which can be used for in-vivo therapy of HGF-related disorders and as antagonists and/or agonists of specific HGF-related receptor(s), and as diagnostic tools for proliferation of endothelial and other system tissue, or as a marker for pathological vascular and/or nervous system de-differentiation or tissue damage. Agonist peptides can be used for tissue regeneration in organs in need, such as regenerating liver following resection, trauma or disease, while antagonist peptides can be used for treatment of proliferative and hyperproliferative disease such as cancer.

It will be appreciated that such agents can be administered or provided to an individual in need thereof per se or as part of a pharmaceutical composition with a pharmaceutical acceptable carrier (e.g., PEG and liposomes). One preferred method of administration of variant HGF precursor polypeptides and/or polynucleotides expressing same, of the present invention, is intravenous administration.

While further reducing the present invention to practice, tissue specific expression of the HGF precursor variant HSHGFR_Skippingexon_7_P (SEQ ID NO:303) was detected, using the methods and compositions taught herein, in tissue samples from Colon, while only WT HGF precursor transcripts were detected in samples from other tissues (FIG. 21). These results suggest the use of the new HGF precursor precursor variants of the present invention [HSHGFR_Skippingexon_3_P (SEQ ID NO:299), HSHGFR_Skippingexon_4_P (SEQ ID NO: 301), HSHGFR_Skippingexon_7_P (SEQ ID NO: 303) and HSHGFR_Skippingexon_9_P (SEQ ID NO: 305)], the polynucleotides encoding same [HSHGFR_Skippingexon_3_T (SEQ ID NO:300), HSHGFR_Skippingexon_4_T (SEQ ID NO: 302), HSHGFR_Skippingexon_7_T (SEQ ID NO: 304) and HSHGFR_Skippingexon_9_T (SEQ ID NO: 306)] as diagnostic markers for disorders such as hepatic disease, cancer progression, cell growth and migration and cell proliferation (mostly in metastasis). Diagnosis according to this aspect of the present invention is effected using immunological assays [e.g., Western Blot, immunohistochemistry, FACS analysis, radio immuno assay (RIA), immunofluorescence, and the like using an antibody directed against the HGF precursor variants ([HSHGFR_Skippingexon_3_P (SEQ ID NO:299), HSHGFR_Skippingexon_4_P (SEQ ID NO: 301), HSHGFR_Skippingexon_7_P (SEQ ID NO: 303) and HSHGFR_Skippingexon_9_P (SEQ ID NO: 305)], or by nucleic acid techniques (NAT) such as RT-PCR, Northern Blot, in situ hybridization, in situ RT-PCR.

Example 46

Splice Variant of Cocaine- and Amphetamine-Regulated Transcript Protein Precursor Background Cocaine- and amphetamine-regulated transcript (CART) encodes a neuropeptide precursor protein that is highly abundant in cells of the hypothalamus. COCAINE- AND AMPHETAMINE-REGULATED transcript (CART) cDNA was originally isolated from rat brain by PCR differential screening of transcripts up-regulated after the administration of cocaine or amphetamine. CART Cocaine- and amphetamine-regulated transcript protein precursor [Contains: CART(1-39); CART(32-89)] gi|2833274|sp|Q16568|CART_HUMAN, SEQ ID NO:650] and its translated peptide are found throughout the central nervous system and peripheral tissues. CART is one of the most abundant mRNAs in the hypothalamus, highly expressed in the arcuate nucleus (ARC), paraventricular nucleus (PVN), dorsomedial nucleus (DMN) and ventromedial nucleus (VMN). Cocaine- and amphetamine-regulated transcript (CART) and CART peptide are abundant in hypothalamic nuclei controlling anterior pituitary function, having established roles in the regulation of feeding.

Two C-terminal CART-derived peptides, CART 42-89 and CART 49-89, have been isolated from rat hypothalamus and arcuate nucleus as well as the pituitary. Both peptides result from proteolytic cleavage events at dibasic residues (KR and KK, respectively) within the CART peptide precursor and thus represent potential biologically active neuropeptides.

CART has been implicated in the control of feeding behavior. CART mRNA and peptide are colocalized with the anorectic peptide αMSH in the ARC and with the orexigenic peptide melanin-concentrating hormone in the lateral hypothalamic area (LHA). Nerve terminals immunoreactive for the orexigenic peptide NPY are closely apposed with CART peptide-containing cell bodies in the PVN, ARC, LHA, and DMN. Intracerebroventricular (icv) injection of the active fragment of CART, CART(55-102), has been shown to activate the immediate early gene c-fos in the PVN, DMN, ARC, and supraoptic nucleus (SON) of the hypothalamus. Intracerebroventricular (ICV) injection of CART peptide results in neuronal activation in the paraventricular nucleus (PVN), rich in corticotrophin-releasing factor (CRH) and thyrotrophin-releasing factor (TRH) immunoreactive neurons. CART peptides have also been detected in the peripheral nervous system, such as the myenteric plexus (Couceryo et al, Synapse 1998; 30:1-8). Both anorexigenic, and orexigenic activities have been ascribed to the CART peptides (Abbott et al Endocrinology 2001; 142:3457-63), in addition to modulation of psychostimulant effects such as abuse and dependent behaviour, locomotor activity associated with mesolimbic dopamine (Jaworski et al Life Sciences 2003; 73:741-47). A specific CART peptide receptor is postulated.

Soluble forms of CART peptide neurotransmitters have been detected in central and peripheral nervous system, and in body fluids. Since the CART peptides have extensive psychostimulant and behavioural activity, ligands constituting agonists and antagonists of specific CART receptor(s), and/or anti-CART peptide antibodies can be useful in upregulating or downregulating a variety of CART-related behaviours, such as abuse and dependency, feeding, etc. Further, since CART peptides are overexpressed in the brain and other nervous system tissue, CART peptides and their homologues can be used as diagnostic markers for proliferation of nervous system tissue or as a marker for pathological nervous system de-differentiation or tissue damage.

Splice Variant HSU16826_Skippingexon_2_T(SEQ ID NO:308) Encodes a New Secreted Form of Cocaine and Amphetamine Regulated Transcript (CART) Protein Precursor HSU16826_Skippingexon_2_P (SEQ ID NO:307).

The present inventors have uncovered a new CART protein precursor variant [HSU16826_Skippingexon_2_P-SEQ ID NO:307; HSU16826_Skippingexon_2_T—SEQ ID NO:308]. The protein coordinates on the transcript start from nucleotide 1 and end at nucleotide 247.

Figure 22:
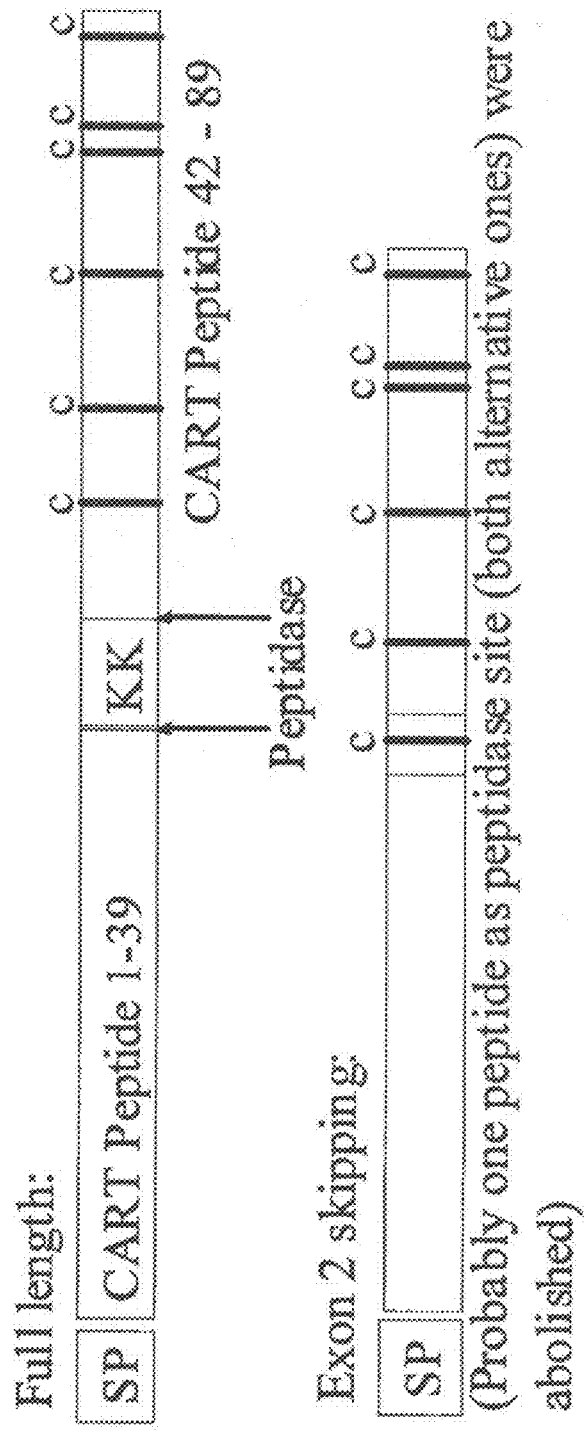
FIG. 22 is a schematic illustration showing the protein domain structure of wild-type CART protein (SwissProt locus: CART_HUMAN; GenBank Accession No. Q16568; SEQ ID NO:134) and the CART variants of the present invention, as described in Example 46 below. Unique regions are indicated.

Alignment of the new CART protein precursor variant [HSU16826_Skippingexon_2_P—SEQ ID NO:307] with the WT CART Cocaine- and amphetamine-regulated transcript protein precursor [GenBank Accession No. Q16568|CART_HUMAN, SEQ ID NO:650], as shown in FIGS. 22 and 136, revealed that 28 consecutive amino acids (amino acids 54-81 of GenBank Accession No. Q16568, SEQ ID NO:650) are missing in the new variant. The new variant uncovered by the present invention is expected to be a secreted, extracellular protein having neuropeptide hormone activity in synaptic transmission and neuropeptide signaling pathways.

Comparison Report Between HSU16826_Skippingexon_2_P and CART_HUMAN (SEQ ID NO:650)

1. An isolated chimeric polypeptide HSU16826_Skippingexon_2_P, comprising a first amino acid sequence being at least 90% homologous to MESSRVRLLPLLGAALLLML-PLLGTRAQEDAELQPRALDIYSAVDDASHEKEL corresponding to amino acids 1-53 of CART_HUMAN, which also corresponds to amino acids 1-53 of HSU16826_Skippingexon_2_P, and a second amino acid sequence being at least 90% homologous to CDAGEQCAVRKGARIGKLCDCPRGTSCNSFLLKCL corresponding to amino acids 82-116 of CART_HUMAN, which also corresponds to amino acids 54-88 of HSU16826_Skippingexon_2_P, wherein said first amino acid sequence and second amino acid sequence are contiguous and in a sequential order.

2. An isolated chimeric edge portion of HSU16826_Skippingexon_2_P, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LC, having a structure as follows: a sequence starting from any of amino acid numbers 53−x to 53; and ending at any of amino acid numbers 54+((n−2)−x), in which x varies from 0 to n−2.

Clinical Applications of the CART Protein Precursor Variant of the Present Invention Since the CART protein precursor variant of the present invention lacks the amino acids 52-81 of the WT CART protein precursor (GenBank Accession No. Q16568, SEQ ID NO:650) it can compete with the endogenous CART protein and related peptides, and interfere with their various activities. The WT CART protein and component peptides have been implicated in regulation of pituitary and hypothalamo-pituitary-adrenal axis function, and regulation of levels of endocrine hormones such as Prolactin, ACTH and GH (Stanley et al, Brain Res 2001 893:186-94). Further, it has been demonstrated that the CART peptide comprising amino acids 42-89, or smaller synthetic fragments thereof, when applied intervertebrocerebroventricularly (i.v.c.), cause a significant, and reversible repression of feeding behaviour, and reduction in body weight (Larsen et al, Obesity Res 2000; 8:590-96).

Thus, the present inventors have uncovered a therapeutic agent, a polypeptide homologous to SEQ ID NO:307 and/or an expressible polynucleotide homologous to SEQ ID NO:308 which can be used to treat a variety of CART-related conditions, such as endocrine imbalance (e.g. diabetes, metabolic dysfunction), abuse and dependency, and feeding behaviours, etc. Since the CART peptides have extensive endocrine and psychostimulant and behavioural activity, CART protein precursor variants such as HSU16826_Skippingexon_2_P (SEQ ID NO:307) which can act as an agonist and/or antagonist of specific CART receptor(s) can be useful in upregulating or downregulating a variety of CART-related behaviours, such as obesity and drug addition, etc. The new CART protein precursor variant of the present invention can also be used to produce novel anti-CART peptide antibodies which can be used for in-vivo therapy of CART-related disorders and as antagonists and/or agonists of specific CART-related receptor(s), and as diagnostic tools for proliferation of nervous system tissue or as a marker for pathological nervous system de-differentiation or tissue damage.

It will be appreciated that such agents can be administered or provided to an individual in need thereof per se or as part of a pharmaceutical composition with a pharmaceutical acceptable carrier (e.g., PEG and liposomes). One preferred method of administration of variant CART protein precursor polypeptides and/or polynucleotides expressing same, of the present invention, is i.v.c. administration (directly to the brain) or other direct administration to the central or peripheral nervous system using an indwelling minipump (ALZET Labs).

While further reducing the present invention to practice, these results suggest the use of the new CART protein precursor variant of the present invention (HSU16826_Skippingexon_2_P—SEQ ID NO:307), the polynucleotide encoding same (HSU16826_Skippingexon_2_T SEQ ID NO:308) as diagnostic markers for nervous system, and specifically neuroendocrine, disorders such as obesity, diabetes and dependency behaviour, neuroendocrine proliferation or de-differentiation, as well as brain and neural tissue tumors. Diagnosis according to this aspect of the present invention is effected using immunological assays [e.g., Western Blot, immunohistochemistry, FACS analysis, radio immuno assay (RIA), immunofluorescence, and the like using an antibody directed against the CART protein precursor variant (HSU16826_Skippingexon_2_P-SEQ ID NO:307)], or by nucleic acid techniques (NAT) such as RT-PCR, Northern Blot, in situ hybridization, in situ RT-PCR.

Example 47

Splice Variants of Dipeptidyl Peptidase IV

Background

Dipeptidyl Peptidase (DPP IV; T-cell activation antigen CD26; TP103; Adenosine deaminase complexing protein-2; ADABP; GenBank Accession No. P27487; DPP4_HUMAN; SEQ ID NO:651) cleaves two amino acids from the N-terminus of the intact, biologically active forms of both so-called incretin hormones, glucagon-like peptide-1 and glucose-dependent insulinotropic polypeptide (formerly known as gastric inhibitory polypeptide), resulting in truncated metabolites, which are largely inactive. Human dipeptidyl peptidase IV (DPP-IV) is a ubiquitously expressed type II transmembrane serine protease. It cleaves the penultimate positioned prolyl bonds at the N terminus of physiologically important peptides such as the incretin hormones glucagon-like peptide 1 and glucose-dependent insulinotropic peptide.

Dipeptidyl peptidase IV (DPPIV/CD26) has a unique enzymatic specificity in cleaving dipeptides from neuropeptides, chemokines, and hormones, and is thus potentially involved in the regulation of functions of the immune, endocrine, and nervous systems. Dipeptidyl peptidase IV deficient rats were found to have behavioural abnormalities, such as increased pain sensitivity and decreased susceptibility to alcohol sedation (Karl et al, Physiol Behav 2003; 80:123-34), and improved glucose tolerance and blunted natural killer cell function (Karl et al., Regul Peptid 2003; 15:81-90), and reduced susceptibility to tumor adhesion and metastatic development (Shingu et al, Cancer Immunol Immunother, 2003, May 8), suggesting that Dipeptidyl peptidase IV is associated with metastatic development, especially lung metastases of breast cancer (Cheng et al, Clin Exp Metastasis 1999; 17:609-15).

Apart from its catalytic activity, it interacts with several proteins, for instance, adenosine deaminase, the HIV gp120 protein, fibronectin, collagen, the chemokine receptor CXCR4, and the tyrosine phosphatase CD45. DPP IV is expressed on a specific set of T lymphocytes, where it is up-regulated after activation. It is also expressed in a variety of tissues, primarily on endothelial and epithelial cells. A soluble form is present in plasma and other body fluids. DPP IV can be used as a diagnostic or prognostic marker for various tumors, hematological malignancies, immunological, inflammatory, psychoneuroendocrine disorders, and viral infections (Lambier, et al, Crit Rev Clin Lab 2003, 40:209-94), particularly for T-cell related pathologies and conditions associated with it's upregulation in activated T lymphocytes.

Splice Variants HSPCHDP7_Skippingexon_7_T (SEQ ID NO:310), HSPCHDP7_Skippingexon_9_T (SEQ ID NO:312), HSPCHDP7_Skippingexon_19_T (SEQ ID NO:314), HSPCHDP7_Skippingexon_21_T (SEQ ID NO:316), HSPCHDP_Skippingexon_22_T (SEQ ID NO:318), HSPCHDP7_Skippingexon_24_T (SEQ ID NO:320), HSPCHDP7_Skippingexon_25_T (SEQ ID NO:322), HSPCHDP7_skippingexon_24_25_T (SEQ ID NO:324) of Dipeptidyl Peptidase IV Encode New Secreted Forms of Dipeptidyl Peptidase IV (DPP IV), HSPCHDP7_Skippingexon_7_P (SEQ ID NO309), HSPCHDP7_Skippingexon_9_P (SEQ ID NO:311), HSPCHDP7_Skippingexon_19_P (SEQ ID NO:313), HSPCHDP7_Skippingexon_21_P (SEQ ID NO:315), HSPCHDP_Skippingexon_22_P (SEQ ID NO:317), HSPCHDP7_Skippingexon_24_P (SEQ ID NO:319), HSPCHDP7_Skippingexon_25_P (SEQ ID NO:321), HSPCHDP7_skippingexon_24_25_P (SEQ ID NO:323), respectively.

HSPCHDP7_Skippingexon_7 Variant Structure

The present inventors have uncovered a new Dipeptidyl peptidase variant [HSPCHDP7_Skippingexon_7_P—SEQ ID NO:309, HSPCHDP7_Skippingexon_7_T—SEQ ID NO:309]. The protein coordinates on the transcript start from nucleotide 561 and end at nucleotide 1064, as set forth in SEQ ID NO: 310.

Figure 23A:
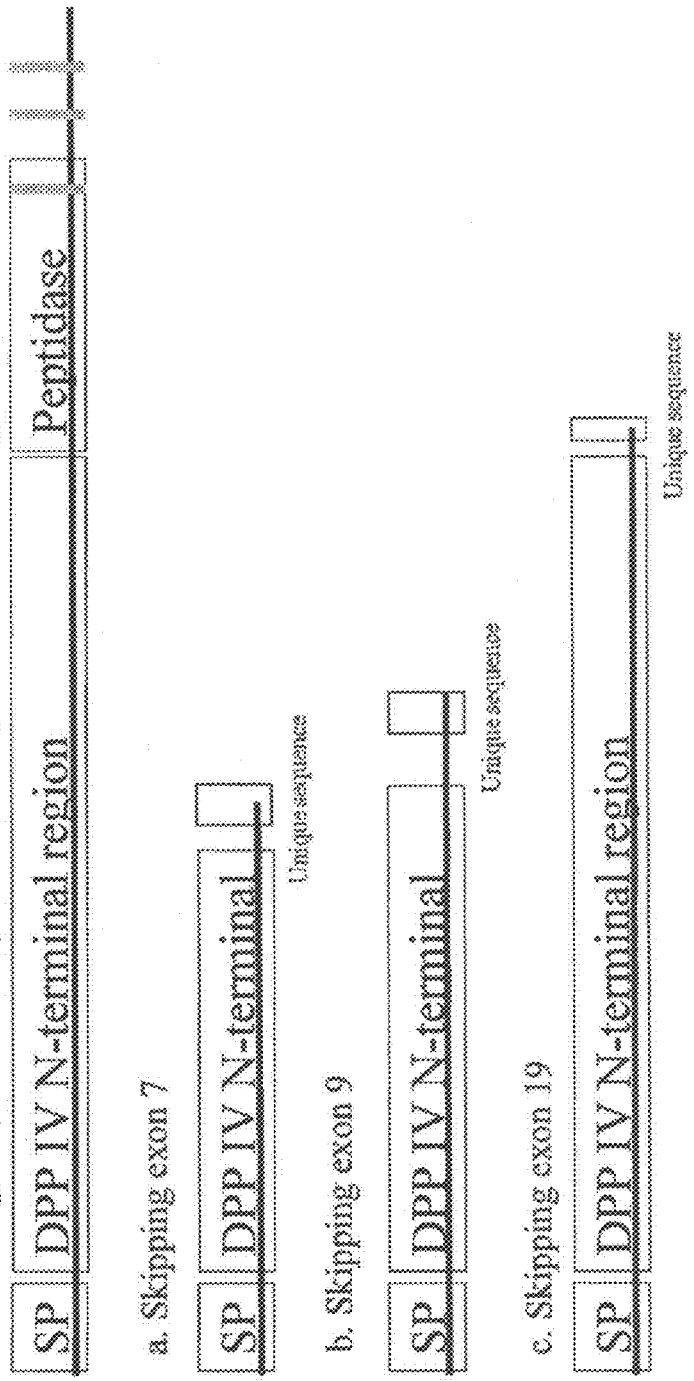
FIG. 23a-b are schematic illustrations showing the protein domain structure of wild-type DPP4 protein (SwissProt locus: DPP4_HUMAN; GenBank Accession No. P27487; SEQ ID NO:135) and the DPP4 variants of the present invention, as described in Examples 47a-h below. Unique regions are indicated. The novel splice variants of DPP4 are as follows: Variant a: skipping exon 7; Variant b: skipping exon 9; Variant c: skipping exon 19; Variant d: skipping exon 21; Variant e: skipping exon 22; Variant f: skipping exon 24; and Variant g: skipping exon 25.

Alignment of the new Dipeptidyl peptidase IV variant [HSPCHDP7_Skippingexon_7_P—SEQ ID NO:309] with the WT DPP IV protein [GenBank Accession No. P27487; DPP4_HUMAN—SEQ ID NO:651], as shown in FIGS. 23a and 137 revealed that the interpro domain IPR002469 Dipeptidylpeptidase IV (CD26) N-terminal (amino acids 43-554 of GenBank Accession No. P27487, SEQ ID NO:651) is reduced, and that the interpro domains ESTERASE—IPR000379 (Peptidase_S9—IPR001375) (amino acids 558-635 of GenBank Accession No. P27487, SEQ ID NO:651) and PRO_ENDOPEP_SER—IPR002471 are missing in the new variant. The new variant uncovered by the present invention is expected to be a secreted, extracellular protein having proteolytic and peptidolytic prolyl oligopeptidase activity.

Comparison Report Between HSPCHDP7_Skippingexon_7_P and DPP4_HUMAN

1. An isolated chimeric polypeptide HSPCHDP7_Skippingexon_7_P, comprising a first amino acid sequence being at least 90% homologous to MKTP-WKVLLGLLGAAALVTIITVPVVLLNKGT-DDATADSRKTYTLTDYLKNT YRLKLYSLRWISDHEY-LYKQENNILVFNAEYGNSSVFLENSTFDEFGHSINDY SISPDGQFILLEYNYVKQWRHSYTASYDIYDLNKR corresponding to amino acids 1-140 of DPP4_HUMAN, which also corresponds to amino acids 1-140 of HSPCHDP7_Skippingexon_7_P, and a second amino acid sequence being at least 70%, optionally at least 80%, preferably at least 85%, more preferably at least 90% and most preferably at least 95% homologous to a polypeptide having the sequence HMFGTMTFMLKLNQIYQVTESHGRGKKI (SEQ ID NO:667) corresponding to amino acids 141-168 of HSPCHDP7_Skippingexon_7_P, wherein said first amino acid sequence and second amino acid sequence are contiguous and in a sequential order.

2. An isolated polypeptide for a tail of HSPCHDP7_Skippingexon_7_P, comprising a polypeptide being at least 70%, optionally at least about 80%, preferably at least about 85%, more preferably at least about 90% and most preferably at least about 95% homologous to the sequence HMFGTMTFMLKLNQIYQVTESHGRGKKI in HSPCHDP7_Skippingexon_7_P.

HSPCHDP7_Skippingexon_9 Variant Structure

The present inventors have uncovered a new Dipeptidyl peptidase variant [HSPCHDP7_Skippingexon_9_P—SEQ ID NO:311, HSPCHDP7_Skippingexon_7_T—SEQ ID NO:312]. The protein coordinates on the transcript start from nucleotide 561 and end at nucleotide 1301, as set forth in SEQ ID NO: 312.

Figure 23B:

Alignment of the new Dipeptidyl peptidase IV variant [HSPCHDP7_Skippingexon_9_P—SEQ ID NO:311] with the WT DPP IV protein [GenBank Accession No. P27487; DPP4_HUMAN—SEQ ID NO:651], as shown in FIGS. 23b and 138, revealed that the interpro domain IPR002469 Dipeptidylpeptidase IV (CD26) N-terminal (amino acids 43-554 of GenBank Accession No. P27487, SEQ ID NO:651) is reduced, and that the interpro domains ESTERASE—IPR000379 (Peptidase_S9—IPR001375) (amino acids 558-635 of GenBank Accession No. P27487, SEQ ID NO:651) and PRO_ENDOPEP_SER—IPR002471 are missing in the new variant. The new variant uncovered by the present invention is expected to be a secreted, extracellular protein having proteolytic and peptidolytic prolyl oligopeptidase activity.

Comparison Report Between HSPCHDP7_Skippingexon_9_P and DPP4_HUMAN

1. An isolated chimeric polypeptide HSPCHDP7_Skippingexon_9_P, comprising a first amino acid sequence being at least 90% homologous to MKTP-WKVLLGLLGAAALVTIITVPVVLLNKGT-DDATADSRKTYTLTDYLKNT YRLKLYSLRWISDHEY-LYKQENNILVFNAEYGNSSVFLENSTFDEFGHSINDY SISPDGQFILLEYNYVKQWRHSYTASY-DIYDLNKRQLITEERIPNNTQWVTWS PVGH-KLAYVWNNDIYVKIEPNLPSYRITWT- GKEDIIYNGITDWVYE corresponding to amino acids 1-204 of DPP4_HUMAN, which also corresponds to amino acids 1-204 of HSPCHDP7_Skippingexon_9_P, and a second amino acid sequence being at least 70%, optionally at least 80%, preferably at least 85%, more preferably at least 90% and most preferably at least 95% homologous to a polypeptide having the sequence GRSCESNCKVLCCK-YRLSQLSHQCNFHTNHCSCFYVDRGSLLV (SEQ ID NO:668) corresponding to amino acids 205-247 of HSPCHDP7_Skippingexon_9_P, wherein said first amino acid sequence and second amino acid sequence are contiguous and in a sequential order.

2. An isolated polypeptide for a tail of HSPCHDP7_Skippingexon_9_P, comprising a polypeptide being at least 70%, optionally at least about 80%, preferably at least about 85%, more preferably at least about 90% and most preferably at least about 95% homologous to the sequence GRSCESNCKVLCCKYRLSQLSHQCNFHT-NHCSCFYVDRGSLLV in HSPCHDP7_Skippingexon_9_P.

HSPCHDP7_Skippingexon_19 Variant Structure

The present inventors have uncovered a new Dipeptidyl peptidase variant [HSPCHDP7_Skippingexon_19_P—SEQ ID NO:313, HSPCHDP7_Skippingexon_19_T—SEQ ID NO:314]. The protein coordinates on the transcript start from nucleotide 561 and end at nucleotide 2171, as set forth in SEQ ID NO: 314.

Alignment of the new Dipeptidyl peptidase IV variant [HSPCHDP7_Skippingexon_19_P—SEQ ID NO:313] with the WT DPP IV protein [GenBank Accession No. P27487; DPP4_HUMAN—SEQ ID NO:651], as shown in FIGS. 23c and 139, revealed that the interpro domains ESTERASE—IPR000379 (Peptidase_S9—IPR001375) (amino acids 558-635 of GenBank Accession No. P27487, SEQ ID NO:651) and PRO_ENDOPEP_SER—IPR002471 are missing in the new variant. The new variant uncovered by the present invention is expected to be a secreted, extracellular protein having proteolytic and peptidolytic prolyl oligopeptidase activity.

Comparison Report Between HSPCHDP7—Skippingexon_19_P and DPP4_HUMAN

1. An isolated chimeric polypeptide HSPCHDP7_Skippingexon_19_P, comprising a first amino acid sequence being at least 90% homologous to MKTP-WKVLLGLLGAAALVTIITVPVVLLNKGT-DDATADSRKTYTLTDYLKNT YRLKLYSLRWISDHEY-LYKQENNILVFNAEYGNSSVFLENSTFDEFGHSINDY SISPDGQFILLEYNYVKQWRHSYTASY-DIYDLNKRQLITEERIPNNTQWVTWS PVGH-KLAYVWNNDIYVKIEPNLPSYRITWT-GKEDIIYNGITDWVYEEEVFSAY SALWWSPNGTFLAYAQFNDTEVPLIEY-SFYSDESLQYPKTVRVPYPKAGAVN PTVKFFVVNTD-SLSSVTNATSIQITAPASMLIGDHYLCD-VTWATQERISLQWL RRIQNYSVMDICDYDESSGRWNCLVAR-QHIEMSTTGWVGRPRPSEPHFTLDG NSFYKIISNE-EGYRHICYFQIDKKDCTFITKGTW-EVIGIEALTSDYLYYISNEYK GMPGGRNLYKIQLSDYTKVTCLSCELN-PERCQYYSVSFSKEAKYYQLRCSGP GLPLYTLHSS-VNDKGLRVLEDNSALDKMLQN-VQMPSKKLDFIILNET corresponding to amino acids 1-522 of DPP4_HUMAN, which also corresponds to amino acids 1-522 of HSPCHDP7_Skippingexon_19_P, and a second amino acid sequence being at least 70%, optionally at least 80%, preferably at least 85%, more preferably at least 90% and most preferably at least 95% homologous to a polypeptide having the sequence SMQAHVVKKQTLSSD (SEQ ID NO:669) corresponding to amino acids 523-537 of HSPCHDP7_Skippingexon_19_P, wherein said first amino acid sequence and second amino acid sequence are contiguous and in a sequential order.

2. An isolated polypeptide for a tail of HSPCHDP7_Skippingexon_19_P, comprising a polypeptide being at least 70%, optionally at least about 80%, preferably at least about 85%, more preferably at least about 90% and most preferably at least about 95% homologous to the sequence SMQAHVVKKQTLSSD in HSPCHDP7_Skippingexon_19_P.

HSPCHDP7_Skippingexon_21 Variant Structure

The present inventors have uncovered a new Dipeptidyl peptidase variant [HSPCHDP7_Skippingexon_21_P—SEQ ID NO:315, HSPCHDP7_Skippingexon_21_T—SEQ ID NO:316]. The protein coordinates on the transcript start from nucleotide 561 and end at nucleotide 2408, as set forth in SEQ ID NO: 316.

Alignment of the new Dipeptidyl peptidase IV variant [HSPCHDP7_Skippingexon_21_P—SEQ ID NO:315] with the WT DPP IV protein [GenBank Accession No. P27487; DPP4_HUMAN—SEQ ID NO:651], as shown in FIGS. 23d and 140, revealed that the interpro domains ESTERASE—IPR000379 (Peptidase_S9—IPR001375) (amino acids 558-635 of GenBank Accession No. P27487, SEQ ID NO:651) and PRO_ENDOPEP_SER—IPR002471 are missing in the new variant. The new variant uncovered by the present invention is expected to be a secreted, extracellular protein having proteolytic and peptidolytic prolyl oligopeptidase activity.

Comparison Report Between HSPCHDP7_Skippingexon_21_P and DPP4_HUMAN

1. An isolated chimeric polypeptide HSPCHDP7_Skippingexon_21_P, comprising a first amino acid sequence being at least 90% homologous to MKTP-WKVLLGLLGAAALVTIITVPVVLLNKGT-DDATADSRKTYTLTDYLKNT YRLKLYSLRWISDHEY-LYKQENNILVFNAEYGNSSVFLENSTFDEFGHSINDY SISPDGQFILLEYNYVKQWRHSYTASY-DIYDLNKRQLITEERIPNNTQWVTWS PVGH-KLAYVWNNDIYVKIEPNLPSYRITWT-GKEDIIYNGITDWVYEEEVFSAY SALWWSPNGTFLAYAQFNDTEVPLIEY-SFYSDESLQYPKTVRVPYPKAGAVN PTVKFFVVNTD-SLSSVTNATSIQITAPASMLIGDHYLCD-VTWATQERISLQWL RRIQNYSVMDICDYDESSGRWNCLVAR-QHIEMSTTGWVGRPRPSEPHFTLDG NSFYKIISNE-EGYRHICYFQIDKKDCTFITKGTW-EVIGIEALTSDYLYYISNEYK GMPGGRNLYKIQLSDYTKVTCLSCELN-PERCQYYSVSFSKEAKYYQLRCSGP GLPLYTLHSS-VNDKGLRVLEDNSALDKMLQN-VQMPSKKLDFIILNETKFWYQ MILPPHFDKSKKYPLLLDVYAGPC-SQKADTVFRLNWATYLASTENIIVASFDG RGS-GYQGDKIMHAINRRLGTFEVEDQIEAA corresponding to amino acids 1-610 of DPP4_HUMAN, which also corresponds to amino acids 1-610 of HSPCHDP7_Skippingexon_21_P, and a second amino acid sequence being at least 70%, optionally at least 80%, preferably at least 85%, more preferably at least 90% and most preferably at least 95% homologous to a polypeptide having the sequence SHMEGT (SEQ ID NO:670) corresponding to amino acids 611-616 of HSPCHDP7_Skippingexon_21_P, wherein said first amino acid sequence and second amino acid sequence are contiguous and in a sequential order.

2. An isolated polypeptide for a tail of HSPCHDP7_Skippingexon_21_P, comprising a polypeptide being at least 70%, optionally at least about 80%, preferably at least about 85%, more preferably at least about 90% and most preferably at least about 95% homologous to the sequence SHMEGT in HSPCHDP7_Skippingexon_21_P.

HSPCHDP_Skippingexon_22 Variant Structure

The present inventors have uncovered a new Dipeptidyl peptidase variant [HSPCHDP_Skippingexon_22_P—SEQ ID NO:317, HSPCHDP_Skippingexon_22_T—SEQ ID NO:318]. The protein coordinates on the transcript start from nucleotide 561 and end at nucleotide 2525, as set forth in SEQ ID NO: 318.

Alignment of the new Dipeptidyl peptidase IV variant [HSPCHDP_Skippingexon_22_P—SEQ ID NO:317] with the WT DPP IV protein [GenBank Accession No. P27487; DPP4_HUMAN—SEQ ID NO:651], as shown in FIGS. 23e and 141, revealed that the interpro domains ESTERASE—IPR000379 (Peptidase_S9—IPR001375) (amino acids 558-635 of GenBank Accession No. P27487, SEQ ID NO:651) and PRO_ENDOPEP_SER—IPR002471 are missing in the new variant. The new variant uncovered by the present invention is expected to be a secreted, extracellular protein having proteolytic and peptidolytic prolyl oligopeptidase activity.

Comparison Report Between HSPCHDP_Skippingexon_22_P and DPP4_HUMAN

1. An isolated chimeric polypeptide HSPCHDP_Skippingexon_22_P, comprising a first amino acid sequence being at least 90% homologous to MKTPWKVLLGLLGAAALVTIITVPVVLLNKGTDDATADSRKTYTLTDYLKNT YRLKLYSLRWISDHEYLYKQENNILVFNAEYGNSSVFLENSTFDEFGHSINDY SISPDGQFILLEYNYVKQWRHSYTASYDIYDLNKRQLITEERIPNNTQWVTWS PVGHKLAYVWNNDIYVKIEPNLPSYRITWTGKEDHYNGITDWVYEEEVFSAY SALWWSPNGTFLAYAQFNDTEVPLIEYSFYSDESLQYPKTVRVPYPKAGAVN PTVKFFVVNTDSLSSVTNATSIQITAPASMLIGDHYLCDVTWATQERISLQWL RRIQNYSVMDICDYDESSGRWNCLVARQHIEMSTTGWVGRERPSEPHFTLDG NSFYKIISNEEGYRHICYFQIDKKDCTFITKGTWEVIGIEALTSDYLYYISNEYK GMPGGRNLYKIQLSDYTKVTCLSCELNPERCQYYSVSFSKEAKYYQLRCSGP GLPLYTLHSSVNDKGLRVLEDNSALDKMLQNVQMPSKKLDFIILNETKFWYQ MILPPHFDKSKKYPLLLDVYAGPCSQKADTVFRLNWATYLASTENIIVASFDG RGSGYQGDKIMHAINRRLGTFEVEDQIEAARQFSKMGFVDNKRIAIWGW corresponding to amino acids 1-629 of DPP4_HUMAN, which also corresponds to amino acids 1-629 of HSPCHDP_Skippingexon_22_P, and a second amino acid sequence being at least 70%, optionally at least 80%, preferably at least 85%, more preferably at least 90% and most preferably at least 95% homologous to a polypeptide having the sequence TQCTQNVTWVSQLQKTTLTITEIQQS (SEQ ID NO:671) corresponding to amino acids 630-655 of HSPCHDP_Skippingexon_22_P, wherein said first amino acid sequence and second amino acid sequence are contiguous and in a sequential order.

2. An isolated polypeptide for a tail of HSPCHDP_Skippingexon_22_P, comprising a polypeptide being at least 70%, optionally at least about 80%, preferably at least about 85%, more preferably at least about 90% and most preferably at least about 95% homologous to the sequence TQCTQNVTWVSQLQKTTLTITEIQQS in HSPCHDP_Skippingexon_22_P.

HSPCHDP7_Skippingexon_24 Variant Structure

The present inventors have uncovered a new Dipeptidyl peptidase variant [HSPCHDP7_Skippingexon_24_P—SEQ ID NO:319, HSPCHDP7_Skippingexon_24_T—SEQ ID NO:320]. The protein coordinates on the transcript start from nucleotide 561 and end at nucleotide 2711, as set forth in SEQ ID NO:320.

Alignment of the new Dipeptidyl peptidase IV variant [HSPCHDP7_Skippingexon_24_P—SEQ ID NO:319] with the WT DPP IV protein [GenBank Accession No. P27487; DPP4_HUMAN—SEQ ID NO:651], as shown in FIGS. 23a and 142, revealed that the two most C-terminal active sites are missing in the new variant. The new variant uncovered by the present invention is expected to be a secreted, extracellular protein having proteolytic and peptidolytic prolyl oligopeptidase activity.

Comparison Report Between HSPCHDP7_Skippingexon_24_P and DPP4_HUMAN

1. An isolated chimeric polypeptide HSPCHDP7_Skippingexon_24_P, comprising a first amino acid sequence being at least 90% homologous to MKTPWKVLLGLLGAAALVTIITVPVVLLNKGTDDATADSRKTYTLTDYLKNT YRLKLYSLRWISDHEYLYKQENNILVFNAEYGNSSVFLENSTFDEFGHSINDY SISPDGQFILLEYNYVKQWRHSYTASYDIYDLNKRQLITEERIPNNTQWVTWS PVGHKLAYVWNNDIYVKIEPNLPSYRITWTGKEDHYNGITDWVYEEEVFSAY SALWWSPNGTFLAYAQFNDTEVPLIEYSFYSDESLQYPKTVRVPYPKAGAVN PTVKFFVVNTDSLSSVTNATSIQITAPASMLIGDHYLCDVTWATQERISLQWL RRIQNYSVMDICDYDESSGRWNCLVARQHIEMSTTGWVGRERPSEPHFTLDG NSFYKIISNEEGYRHICYFQIDKKDCTFITKGTWEVIGIEALTSDYLYYISNEYK GMPGGRNLYKIQLSDYTKVTCLSCELNPERCQYYSVSFSKEAKYYQLRCSGP GLPLYTLHSSVNDKGLRVLEDNSALDKMLQNVQMPSKKLDFIILNETKFWYQ MILPPHFDKSKKYPLLLDVYAGPCSQKADTVFRLNWATYLASTENIIVASFDG RGSGYQGDKIMHAINRRLGTFEVEDQIEAARQFSKMGFVDNKRIAIWGWSYG GYVTSMVLGSGSGVFKCGIAVAPVSRWEYYDSVYTERYMGLPTPEDNLDHY R corresponding to amino acids 1-684 of DPP4_HUMAN, which also corresponds to amino acids 1-684 of HSPCHDP7_Skippingexon_24_P, and a second amino acid sequence being at least 70%, optionally at least 80%, preferably at least 85%, more preferably at least 90% and most preferably at least 95% homologous to a polypeptide having the sequence ITFTFSSQLRSPKPWSMLEWISRQCGILMKTME (SEQ ID NO:672) corresponding to amino acids 685-717 of HSPCHDP7_Skippingexon_24_P, wherein said first amino acid sequence and second amino acid sequence are contiguous and in a sequential order.

2. An isolated polypeptide for a tail of HSPCHDP7_Skippingexon_24_P, comprising a polypeptide being at least 70%, optionally at least about 80%, preferably at least about 85%, more preferably at least about 90% and most preferably at least about 95% homologous to the sequence ITFTFSSQLRSPKPWSMLEWISRQCGILMKTME in HSPCHDP7_Skippingexon_24_P.

HSPCHDP7_Skippingexon_25 Variant Structure

The present inventors have uncovered a new Dipeptidyl peptidase variant [HSPCHDP7_Skippingexon_25_P—SEQ ID NO:321, HSPCHDP7_Skippingexon_25_T—SEQ ID NO:322]. The protein coordinates on the transcript start from nucleotide 561 and end at nucleotide 2693, as set forth in SEQ ID NO: 322.

Alignment of the new Dipeptidyl peptidase IV variant [HSPCHDP7_Skippingexon_25_P—SEQ ID NO:321] with the WT DPP IV protein [GenBank Accession No. P27487; DPP4_HUMAN—SEQ ID NO:651], as shown in FIGS. 23g and 143, revealed that the most C-terminal active site of the WT DPP IV protein is missing in the new variant. The new variant uncovered by the present invention is expected to be a secreted, extracellular protein having proteolytic and peptidolytic prolyl oligopeptidase activity.

Comparison Report Between HSPCHDP7_Skippingexon_25_P and DPP4_HUMAN

1. An isolated chimeric polypeptide HSPCHDP7_Skippingexon_25_P, comprising a first amino acid sequence being at least 90% homologous to MKTPWKVLLGLLGAAALVTIITVPVVLLNKGTDDATADSRKTYTLTDYLKNT YRLKLYSLRWISDHEYLYKQENNILVFNAEYGNSSVFLENSTFDEFGHSINDY SISPDGQFILLEYNYVKQWRHSYTASYDIYDLNKRQLITEERIPNNTQWVTWS PVGHKLAYVWNNDIYVKIEPNLPSYRITWTGKEDIIYNGITDWVYEEEVFSAY SALWWSPNGTFLAYAQFNDTEVPLIEYSFYSDESLQYPKTVRVPYPKAGAVN PTVKFFVVNTDSLSSVTNATSIQITAPASMLIGDHYLCDVTWATQERISLQWL RRIQNYSVMDICDYDESSGRWNCLVARQHIEMSTTGWVGRPRPSEPHFTLDG NSFYKIISNEEGYRHICYFQIDKKDCTFITKGTWEVIGIEALTSDYLYYISNEYK GMPGGRNLYKIQLSDYTKVTCLSCELNPERCQYYSVSFSKEAKYYQLRCSGP GLPLYTLHSSVNDKGLRVLEDNSALDKMLQNVQMPSKKLDFIILNETKFWYQ MILPPHFDKSKKYPLLLDVYAGPCSQKADTVFRLNWATYLASTENIIVASFDG RGSGYQGDKIMHAINRRLGTFEVEDQIEAARQFSKMGFVDNKRIAIWGWSYG GYVTSMVLGSGSGVFKCGIAVAPVSRWEYYDSVYTERYMGLPTPEDNLDHY RNSTVMSRAENFKQVEYLLIHGTAD corresponding to amino acids 1-708 of DPP4_HUMAN, which also corresponds to amino acids 1-708 of HSPCHDP7_Skippingexon_25_P, and a second amino acid sequence being at least 70%, optionally at least 80%, preferably at least 85%, more preferably at least 90% and most preferably at least 95% homologous to a polypeptide having the sequence VVY (SEQ ID NO:673) corresponding to amino acids 709-711 of HSPCHDP7_Skippingexon_25_P, wherein said first amino acid sequence and second amino acid sequence are contiguous and in a sequential order.

HSPCHDP7_Skippingexon_24_25 Variant Structure

The present inventors have uncovered a new Dipeptidyl peptidase variant [HSPCHDP7_Skippingexon_24_25_P—SEQ ID NO:323, HSPCHDP7_Skippingexon_24_25_T—SEQ ID NO:324]. The protein coordinates on the transcript start from nucleotide 561 and end at nucleotide 2711, as set forth in SEQ ID NO: 324.

Alignment of the new Dipeptidyl peptidase IV variant [HSPCHDP7_Skippingexon_24_25_P—SEQ ID NO:323] with the WT DPP IV protein [GenBank Accession No. P27487; DPP4_HUMAN—SEQ ID NO:651], as shown in FIGS. 23h and 144, revealed that the two most C-terminal active sites of the WT DPP IV protein are missing in the new variant. The new variant uncovered by the present invention is expected to be a secreted, extracellular protein having proteolytic and peptidolytic prolyl oligopeptidase activity.

Comparison Report Between HSPCHDP7_skippingexon_24_25_P and DPP4_HUMAN

1. An isolated chimeric polypeptide HSPCHDP7_skippingexon_24_25_P, comprising a first amino acid sequence being at least 90% homologous to MKTPWKVLLGLLGAAALVTIITVPVVLLNKGTDDATADSRKTYTLTDYLKNT YRLKLYSLRWISDHEYLYKQENNILVFNAEYGNSSVFLENSTFDEFGHSINDY SISPDGQFILLEYNYVKQWRHSYTASYDIYDLNKRQLITEERIPNNTQWVTWS PVGHKLAYVWNNDIYVKIEPNLPSYRITWTGKEDHYNGITDWVYEEEVFSAY SALWWSPNGTFLAYAQFNDTEVPLIEYSFYSDESLQYPKTVRVPYPKAGAVN PTVKFFVVNTDSLSSVTNATSIQITAPASMLIGDHYLCDVTWATQERISLQWL RRIQNYSVMDICDYDESSGRWNCLVARQHIEMSTTGWVGRPRPSEPHFTLDG NSFYKIISNEEGYRHICYFQIDKKDCTFITKGTWEVIGIEALTSDYLYYISNEYK GMPGGRNLYKIQLSDYTKVTCLSCELNPERCQYYSVSFSKEAKYYQLRCSGP GLPLYTLHSSVNDKGLRVLEDNSALDKMLQNVQMPSKKLDFIILNETKFWYQ MILPPHFDKSKKYPLLLDVYAGPCSQKADTVERLNWATYLASTENIIVASFDG RGSGYQGDKIMHAINRRLGTFEVEDQIEAARQFSKMGFVDNKRIAIWGWSYG GYVTSMVLGSGSGVFKCGIAVAPVSRWEYYDSVYTERYMGLPTPEDNLDHY R corresponding to amino acids 1-684 of DPP4_HUMAN, which also corresponds to amino acids 1-684 of HSPCHDP7_skippingexon_24_25_P, and a second amino acid sequence being at least 90% homologous to WYTDEDHGIASSTAHQHIYTHMSHFIKQCFSLP corresponding to amino acids 734-766 of DPP4_HUMAN, which also corresponds to amino acids 685-717 of HSPCHDP7_skippingexon_24_25_P, wherein said first amino acid sequence and second amino acid sequence are contiguous and in a sequential order.

2. An isolated chimeric edge portion of HSPCHDP7_skippingexon_24_25_P, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise RW, having a structure as follows: a sequence starting from any of amino acid numbers 684-x to 684; and ending at any of amino acid numbers 685+((n−2)−x), in which x varies from 0 to n−2.

Clinical Applications of the New Dipeptidyl Peptidase IV Variants of the Present Invention.

Thus the present inventors have uncovered therapeutic agents, a polypeptide homologous to SEQ ID NO:309, 311, 313, 315, 317, 319, 321, or 323 and/or an expressible polynucleotide homologous to SEQ ID NO:310, 312, 314, 316, 318, 320, 322, 324 which can be used to treat conditions associated with reduced DPP IV activity, such as the behavioural abnormalities and reduced NK cell function described above (Karl et al, Physiol Behav 2003; 80:123-34).

It will be appreciated that such an agent can be administered or provided to an individual in need thereof per use or as part of a pharmaceutical composition with a pharmaceutically acceptable carrier (e.g., PEG and liposomes).

While further reducing the present invention to practice, these results suggest the use of the new Dipeptidy peptidase IV variants of the present invention described hereinabove (e.g., SEQ ID NO:309-324) as diagnostic markers for various tumors, hematological malignancies, immunological, inflammatory, psychoneuroendocrine disorders, and viral infections, as well as for proliferation, de-differentiation, and metastatic dissemination of cancer, such as breast cancer. Diagnosis according to this aspect of the present invention is effected using immunological assays [e.g., Western Blot, immunohistochemistry, FACS analysis, radio immuno assay (RIA), immunofluorescence, and the like using an antibody directed against the Dipeptidyl peptidase IV variants (e.g., SEQ ID NO:309, 311, 313, 315, 317, 319, 321, 323), or by nucleic acid techniques (NAT) such as RT-PCR, Northern Blot, in situ hybridization, in situ RT-PCR.

Example 48

Splice Variants of CD154

Background

CD154, also named CD40L (SwissProt accession: TNF5_HUMAN, SEQ ID NO:136; synonyms: Tumor necrosis factor ligand superfamily member 5; CD40 ligand (CD40L); TRAP; T cell antigen Gp39), engages its receptor, CD40, promoting cell survival and costimulatory protein expression necessary for interaction with T-lymphocytes. CD40 was originally described as a receptor responsible for the activation and differentiation of B-lymphocytes. Thus, interaction of B- and T-cells via the CD40-CD154 system allows mutual activation, with B-cells secreting antibodies and T-cells becoming effector cells producing cytokines (Kehry (1996) J. Immunol. 156: 2345-2348).

The CD40-CD154 system has wider implications than mere activation of B- and T-lymphocytes (Schonbeck and Libby (2001) Cell. Mol. Life Sci. 58: 4-43). CD40 is also expressed by migratory immune cells such as macrophages and dendritic cells, which present antigens and activate T-lymphocytes. Engagement of CD40 by T-lymphocyte CD154 activates these immune cells to express new immune modulators, such as the cytokines IL-1, IL-12 and TNFα (Van Kooten and Banchereau (2000) J. Leukoc. Biol. 67: 2-17).

Recent studies reveal that non-hematopoietic cells, including fibroblasts, endothelial cells, smooth muscle cells and some epithelial cells, constitutively display CD40 on their surface (Schonbeck and Libby, 2001 supra), and that this expression is upregulated following exposure to IFN?. Activation of CD40 signaling in non-hematopoietic cells via CD154 results in new cellular functions, including synthesis of pro-inflammatory cytokines (van Kooten and Banchereau, 2000 supra). CD40 engagement on human fibroblasts and endothelial cells induces synthesis of cyclooxygenase (COX-2) and production of prostaglandins. CD40 engagement on endothelial and vascular smooth muscle cells induces synthesis of matrix matalloproteinases (MMP). These enzymes degrade collagens and other connective tissue proteins crucial for the stability of atherosclerotic plaques and their fibrous caps.

Initially, it was thought that CD154 is expressed only on the surface of T-lymphocytes after their activation. However, CD154 was also found to be expressed by eosinophils and mast cells (Schonbeck and Libby, 2001 supra). In addition, human platelets have preformed CD154 inside them. Once activated by thrombin or other mediators, platelet internal stores of CD154 are exported to the surface where some is secreted (Hen et al., 1998, Nature 391: 591-594). Several other cell types are now known to have CD154 stored within. These include macrophages, B-lymphocytes, endothelial cells and smooth muscle cells.

A number of pathological processes of chronic inflammatory diseases in humans, and several experimental animal models of chronic inflammation, were shown to be dependent upon or involve the CD40-CD154 system. These include graft-versus-host disease, transplant rejection, neurodegenerative disorders, atherosclerosis, pulmonary fibrosis, autoimmune diseases such as lupus nephritis, systemic lupus erythematosus, rheumatoid arthritis, multiple sclerosis, as well as hematological malignancies and other cancers. A remarkable spectrum of chronic inflammatory conditions can be blocked or substantially reduced by disrupting the CD40-CD154 system. These studies typically employ either mice with targeted disruption of either CD40 or CD154 genes, or use neutralizing monoclonal anti-CD154 antibodies (van Kooten and Banchereau, 2000 supra). These antibodies appear to work by disrupting the communication bridge constructed by CD40-CD154. The animals in these experimental models appear to be no worse for having this system disrupted for extended periods of time.

Splice Variants CD154 skip 3 (SEQ ID NO:657) and CD154 skip 4 (SEQ ID NO:325) Encode New Forms of CD154 (SEQ ID NOs:656 and 326, Respectively)

The present inventors have uncovered 2 new splice variants of CD154 (SwissProt accession: TNF5_HUMAN, SEQ ID NO:136), CD154 skip 3 [CD154 skip 3-SEQ ID NO:656 (FIG. 28*b*), and CD154 skip4-SEQ ID NO:326 (FIG. 28*f*)] were uncovered using the methods described above.

CD154 skip 3 Variant Structure

CD154 splice variant skipping exon 3 (CD154 skip 3_P) (SEQ ID NO:656, FIG. 28*b*) contains 96 N-terminal amino acids identical to the wild type CD154, and 10 unique amino acids at it's C-terminus. The nucleic acid sequence (SEQ ID NO:657) and the amino acid sequence of the CD154 splice variant skip 3 (SEQ ID NO:656) are described in FIGS. 28*a* and 28*b*, respectively. Alignment of the new CD154 variant with the WT CD 154 (SwissProt accession: TNF5_HUMAN—SEQ ID NO:136) is shown in FIG. 29.

Six out of ten unique amino acids of the new CD154 splice variant skip 3 appear in the mutated CD154 derived from patients with hyper-IgM syndrome (Ramesh N, et al., Int Immunol. 1993 July; 5(7): 769-73; gi AAD13982, (SEQ ID NO:642, FIG. 28*c*). Alignment between the mRNA sequence derived from HIgM syndrome and that of the new splice variant CD 154 skip 3 is shown in FIG. 28*d*. The difference between the two isoforms is due to a single nucleotide deletion in the previously described mRNA derived from the HIgM syndrome (gi: S66178, SEQ ID NO:642, FIG. 28*d*). Thus, the novel splice variant of CD154 splice variant skip 3 might be involved in the X-linked hyper-IgM syndrome.

CD 154 Skip 4

Figure 32B:
FIG. 32 is a structural prediction of the partial wild type CD154 protein, demonstrating the predicted modular structure of the regions involved in CD40 binding and these involved in integrin α2,βIII binding. The prediction was performed using Cn3Dv4.1 structural viewer of NCBI.

CD 154 splice variant skipping exon 4 contains an in frame deletion of 21 amino acids at the positions 116-136 of the original wild type CD154 (SwissProt accession: TNF5_HUMAN, SEQ ID NO:136). The nucleic acid sequence (CD skip 4, SEQ ID NO:325) and the amino acid sequence of the novel splice variant (CD154 skip 4_P; SEQ ID NO:326) is presented in FIGS. 28*e* and 28*f*, respectively. The splice variant skipping exon 4 (CD 154 skip 4_P, SEQ ID NO:326) of the present invention contains the amino acids involved in CD40 binding, but not the amino acids predicted to be involved in the Integrin α2, βIII binding (FIG. 30). The two domains were predicted to be modular in the three-dimensional structure of the CD154, as can be seen in FIGS. 32a and b, and therefore each domain can function independently. An mRNA encoding a polypeptide similar to the new CD154 splice variant skipping exon 4 was identified in Macaca nemestrina (FIG. 31a, gi|21363028|sp|Q9BDM7|TNF5_MACNE, SEQ ID NO:137), while in other primates, including other types of Macacas, there is a wild type CD154. The alignment of the Macaca protein (SEQ ID NO:137) and the human wild type CD154 (SwissProt accession: TNF5_HUMAN, SEQ ID NO:136) or the novel splice variant of CD154 of the present invention, CD 154 skip 4_P (SEQ ID NO:326, FIG. 28f), is presented in FIGS. 31b and c, respectively. The evolutional conservation of the sequence supports the novel splicing prediction of CD154 skip 4.

Clinical Applications

Since interaction between CD 154 and the CD40 receptor results in the induction of proinflammatory cytokines, splice variants of the CD40 ligand CD154 can be used as CD40 receptor antagonists, as therapeutic agents for the treatment of inflammatory disease such as graft-versus-host disease, transplant rejection, neurodegenerative disorders, atherosclerosis, pulmonary fibrosis, autoimmune diseases such as lupus nephritis, systemic lupus erythematosus, rheumatoid arthritis, multiple sclerosis, as well as hematological malignancies and other cancers, and other chronic inflammatory conditions. Treatment can effected by providing to an individual suffering from a CD40-CD154 related condition described hereinabove a polypeptide homologous to SEQ ID NOs:656 (CD154 skip 3_P) and/or 326 (CD 154 skip_4) or a polynucleotide homologous to SEQ ID NOs:657 (CD 154 skip 3) or 325 (CD 154 skip 4) to treat the condition. It will be appreciated that such therapeutic agents (i.e., the polypeptide, and or the polynucleotide) or can be administered or provided as part of a pharmaceutical composition with a pharmaceutically acceptable carrier (e.g., PEG and liposomes).

While further reducing the present invention to practice, the present inventors have uncovered that the CD154 skip 3 variant of the present invention (CD154 skip 3_P, SEQ ID NO:656) and the polynucleotide encoding same (SEQ ID NO:657) can be used as diagnostic markers for hyper IgM (HIgM) syndrome.

Diagnosis according to this aspect of the present invention is effected using immunological assays [e.g., Western Blot, immunohistochemistry, FACS analysis, radio immuno assay (RIA), immunofluorescence, and the like using an antibody directed against the CD154 skip 3_P, SEQ ID NO:656 variant, or by nucleic acid techniques (NAT) such as RT-PCR, Northern Blot, in situ hybridization, in situ RT-PCR.

Example 49

Description for Cluster HUMEGFAA

Cluster HUMEGFAA features 16 transcript(s) and 51 segment(s) of interest, the names for which are given in Tables 68 and 69, respectively, the sequences themselves are given in SEQ ID NOs 428-443; 444-494 and 495-496, for transcripts; segments and proteins, respectively. The selected protein variants are given in Table 70.

TABLE 68

Transcripts of interest

| Transcript Name | SEQ ID NO |
|---|---|
| HUMEGFAA_PEA_2_T0 | 428 |
| HUMEGFAA_PEA_2_T4 | 429 |
| HUMEGFAA_PEA_2_T6 | 430 |
| HUMEGFAA_PEA_2_T7 | 431 |
| HUMEGFAA_PEA_2_T10 | 432 |
| HUMEGFAA_PEA_2_T11 | 433 |
| HUMEGFAA_PEA_2_T13 | 434 |
| HUMEGFAA_PEA_2_T16 | 435 |
| HUMEGFAA_PEA_2_T17 | 436 |
| HUMEGFAA_PEA_2_T19 | 437 |
| HUMEGFAA_PEA_2_T21 | 438 |
| HUMEGFAA_PEA_2_T22 | 439 |
| HUMEGFAA_PEA_2_T25 | 440 |
| HUMEGFAA_PEA_2_T29 | 441 |
| HUMEGFAA_PEA_2_T43 | 442 |
| HUMEGFAA_PEA_2_T44 | 443 |

TABLE 69

Segments of interest

| Segment Name | SEQ ID NO: |
|---|---|
| HUMEGFAA_PEA_2_node_0 | 444 |
| HUMEGFAA_PEA_2_node_1 | 445 |
| HUMEGFAA_PEA_2_node_2 | 446 |
| HUMEGFAA_PEA_2_node_3 | 447 |
| HUMEGFAA_PEA_2_node_10 | 448 |
| HUMEGFAA_PEA_2_node_13 | 449 |
| HUMEGFAA_PEA_2_node_18 | 450 |
| HUMEGFAA_PEA_2_node_23 | 451 |
| HUMEGFAA_PEA_2_node_25 | 452 |
| HUMEGFAA_PEA_2_node_26 | 453 |
| HUMEGFAA_PEA_2_node_30 | 454 |
| HUMEGFAA_PEA_2_node_34 | 455 |
| HUMEGFAA_PEA_2_node_37 | 456 |
| HUMEGFAA_PEA_2_node_38 | 457 |
| HUMEGFAA_PEA_2_node_41 | 458 |
| HUMEGFAA_PEA_2_node_44 | 459 |
| HUMEGFAA_PEA_2_node_56 | 460 |
| HUMEGFAA_PEA_2_node_58 | 461 |

TABLE 69-continued

Segments of interest

| Segment Name | SEQ ID NO: |
| --- | --- |
| HUMEGFAA_PEA_2_node_60 | 462 |
| HUMEGFAA_PEA_2_node_7 | 463 |
| HUMEGFAA_PEA_2_node_12 | 464 |
| HUMEGFAA_PEA_2_node_14 | 465 |
| HUMEGFAA_PEA_2_node_15 | 466 |
| HUMEGFAA_PEA_2_node_16 | 467 |
| HUMEGFAA_PEA_2_node_17 | 468 |
| HUMEGFAA_PEA_2_node_21 | 469 |
| HUMEGFAA_PEA_2_node_22 | 470 |
| HUMEGFAA_PEA_2_node_24 | 471 |
| HUMEGFAA_PEA_2_node_27 | 472 |
| HUMEGFAA_PEA_2_node_28 | 473 |
| HUMEGFAA_PEA_2_node_29 | 474 |
| HUMEGFAA_PEA_2_node_31 | 475 |
| HUMEGFAA_PEA_2_node_32 | 476 |
| HUMEGFAA_PEA_2_node_33 | 477 |
| HUMEGFAA_PEA_2_node_35 | 478 |
| HUMEGFAA_PEA_2_node_36 | 479 |
| HUMEGFAA_PEA_2_node_39 | 480 |
| HUMEGFAA_PEA_2_node_40 | 481 |
| HUMEGFAA_PEA_2_node_42 | 482 |
| HUMEGFAA_PEA_2_node_43 | 483 |
| HUMEGFAA_PEA_2_node_45 | 484 |
| HUMEGFAA_PEA_2_node_46 | 485 |
| HUMEGFAA_PEA_2_node_47 | 486 |
| HUMEGFAA_PEA_2_node_48 | 487 |
| HUMEGFAA_PEA_2_node_49 | 488 |
| HUMEGFAA_PEA_2_node_50 | 489 |
| HUMEGFAA_PEA_2_node_52 | 490 |
| HUMEGFAA_PEA_2_node_53 | 491 |
| HUMEGFAA_PEA_2_node_54 | 492 |
| HUMEGFAA_PEA_2_node_55 | 493 |
| HUMEGFAA_PEA_2_node_57 | 494 |

TABLE 70

Proteins of interest

| Protein Name | SEQ ID NO: | Protein Length | Corresponding Transcript(s) |
| --- | --- | --- | --- |
| HUMEGFAA_PEA_2_P3 | 495 | P143 | HUMEGFAA_PEA_2_T0; HUMEGFAA_PEA_2_T4; HUMEGFAA_PEA_2_T6; HUMEGFAA_PEA_2_T7; HUMEGFAA_PEA_2_T10; HUMEGFAA_PEA_2_T11; HUMEGFAA_PEA_2_T13; HUMEGFAA_PEA_2_T16; HUMEGFAA_PEA_2_T17; HUMEGFAA_PEA_2_T19; HUMEGFAA_PEA_2_T21; HUMEGFAA_PEA_2_T22; HUMEGFAA_PEA_2_T25; HUMEGFAA_PEA_2_T29; HUMEGFAA_PEA_2_T43 |
| HUMEGFAA_PEA_2_P14 | 496 | P131 | HUMEGFAA_PEA_2_T44 |

These sequences are variants of the known protein Vascular endothelial growth factor A precursor (SwissProt accession identifier VEGA_HUMAN; known also according to the synonyms VEGF-A; Vascular permeability factor; VPF), SEQ ID NO: 196, referred to herein as the previously known protein.

Protein Vascular endothelial growth factor A precursor is known or believed to have the following function(s): Growth factor active in angiogenesis, vasculogenesis and endothelial cell growth. It induces endothelial cell proliferation, promotes cell migration, inhibits apoptosis, and induces permeabilization of blood vessels. It binds to the VEGFR1/Flt-1 and VEGFR2/Kdr receptors and to heparan sulfate and heparin. Neuropilin-1 binds isoforms VEGF-165 and VEGF-145. The sequence for protein Vascular endothelial growth factor A precursor is given in SEQ ID NO: 196, as "Vascular endothelial growth factor A precursor amino acid sequence". Known polymorphisms for this sequence are as shown in Table 71.

TABLE 71

Amino acid mutations for Known Protein

| SNP position(s) on amino acid sequence | Comment |
| --- | --- |
| 87 | C → S |
| 210 | D → H |

Protein Vascular endothelial growth factor A precursor localization is believed to be secreted. The localization of the known splice variants is as follows: VEGF121 is acidic and freely secreted. VEGF165 is more basic, has heparin-binding properties and, although a significant proportion remains cell-associated, most is freely secreted. VEGF189 is very basic; it is cell-associated after secretion and is bound avidly by heparin and the extracellular matrix, although it may be released as a soluble form by heparin, heparinase or plasmin.

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein or of drugs directed to this protein are as follows: Endothelial growth factor receptor kinase inhibitor; Angiogenesis modulator; Endothelial growth factor modulator. A therapeutic role for a protein represented by the cluster has been predicted. The cluster was assigned this field because there was information in the drug database or the public databases (e.g., described herein above) that this protein, or part thereof, is used or can be used for a potential therapeutic indication: Symptomatic antidiabetic; Anticancer; Ophthalmological; Vulnerary; Cardiovascular.

The following GO Annotation(s) apply to the previously known protein. The following annotation(s) were found: cell cycle control; angiogenesis; stress response; homophilic cell adhesion; signal transduction; cell proliferation; positive control of cell proliferation, which are annotation(s) related to Biological Process; vascular endothelial growth factor receptor ligand; growth factor; heparin binding, which are annotation(s) related to Molecular Function; and extracellular; soluble fraction; membrane, which are annotation(s) related to Cellular Component.

The GO assignment relies on information from one or more of the SwissProt/TremB1 Protein knowledgebase, or Locuslink.

As noted above, cluster HUMEGFAA features 16 transcript(s), which were listed in Table 1 above. These transcript(s) encode for protein(s) which are variant(s) of protein Vascular endothelial growth factor A precursor. A description of each variant protein according to the present invention is now provided.

Variant protein HUMEGFAA_PEA_2_P3 (SEQ ID NO:495) according to the present invention is encoded by transcript(s) HUMEGFAA_PEA_2_T0, HUMEGFAA_PEA_2_T4, HUMEGFAA_PEA_2_T6, HUMEGFAA_PEA_2_T7, HUMEGFAA_PEA_2_T10, HUMEGFAA_PEA_2_T11, HUMEGFAA_PEA_2_T13, HUMEGFAA_PEA_2_T16, HUMEGFAA_PEA_2_T17, HUMEGFAA_PEA_2_T19, HUMEGFAA_PEA_2_T21, HUMEGFAA_PEA_2_T22, HUMEGFAA_PEA_2_T25, HUMEGFAA_PEA_2_T29 and HUMEGFAA_PEA_2_T43. An alignment is given to the known protein (Vascular endothelial growth factor A precursor; SEQ ID NO:196) in FIG. 152. One or more alignments to one or more previously published protein sequences in given in FIG. 153. A brief description of the relationship of the variant protein according to the present invention to each such aligned protein is as follows:

Comparison Report Between HUMEGFAA_PEA_2_P3 and VEGA_HUMAN:

1. An isolated chimeric polypeptide HUMEGFAA_PEA_2_P3, comprising a first amino acid sequence being at least 90% homologous to MNFLLSWVHWSLALLLYLHHAK-WSQAAPMAEGGGQNHHEVVKFMDVYQR SYCHPI-ETLVDIFQEYPDEIEYIFKPSCVPLM-RCGGCCNDEGLECVPTEESNITM Q corresponding to amino acids 1-105 of VEGA_HUMAN, which also corresponds to amino acids 1-105 of HUMEGFAA_PEA_2_P3, and a second amino acid sequence being at least 70%, optionally at least 80%, preferably at least 85%, more preferably at least 90% and most preferably at least 95% homologous to a polypeptide having the sequence VGIFGKWGKGGI-GRGVTLWEQVVPGRFLARFALSGSCP corresponding to amino acids 106-143 of HUMEGFAA_PEA_2_P3, wherein said first amino acid sequence and second amino acid sequence are contiguous and in a sequential order.

2. An isolated polypeptide for a tail of HUMEGFAA_PEA_2_P3, comprising a polypeptide being at least 70%, optionally at least about 80%, preferably at least about 85%, more preferably at least about 90% and most preferably at least about 95% homologous to the sequence VGIFGK-WGKGGIGRGVTLWEQVVPGRFLARFALSGSCP in HUMEGFAA_PEA_2_P3.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMEGFAA_PEA_2_P3 also has the following non-silent SNPs (Single Nucleotide Polymorphisms) as listed in Table 72, (given according to their position(s) on the amino acid sequence, with the alternative amino acid(s) listed; the last column indicates whether the SNP is known or not; the presence of known SNPs in variant protein HUMEGFAA_PEA_2_P3 sequence provides support for the deduced sequence of this variant protein according to the present invention).

TABLE 72

Amino acid mutations

| SNP position(s) on amino acid sequence | Alternative amino acid(s) | Previously known SNP? |
|---|---|---|
| 122 | T → R | Yes |

The glycosylation sites of variant protein HUMEGFAA_PEA_2_P3, as compared to the known protein Vascular endothelial growth factor A precursor, are described in Table 73 (given according to their position(s) on the amino acid sequence in the first column; the second column indicates whether the glycosylation site is present in the variant protein; and the last column indicates whether the position is different on the variant protein).

TABLE 73

Glycosylation site(s)

| Position(s) on known amino acid sequence | Present in variant protein? | Position in variant protein? |
|---|---|---|
| 101 | yes | 101 |

The variant protein has the following domains, as determined by using InterPro. The domains are described in Table 74, hereinbelow.

TABLE 74

InterPro domain(s)

| InterPro ID | Domain description | Analysis type | Position(s) on protein |
|---|---|---|---|
| IPR000072 | Platelet-derived growth factor (PDGF) | HMMPfam | 52-132 |
| IPR000072 | Platelet-derived growth factor (PDGF) | HMMSmart | 50-129 |
| IPR000072 | Platelet-derived growth factor (PDGF) | ScanRegExp | 75-87 |

TABLE 74-continued

InterPro domain(s)

| InterPro ID | Domain description | Analysis type | Position(s) on protein |
|---|---|---|---|
| IPR000072 | Platelet-derived growth factor (PDGF) | BlastProDom | 43-106 |
| IPR000072 | Platelet-derived growth factor (PDGF) | ProfileScan | 39-106 |

The coding portion of transcript HUMEGFAA_PEA_2_T0 starts at position 1041 and ends at position 1469. The transcript also has the following SNPs as listed in Table 75 (given according to their position on the nucleotide sequence, with the alternative nucleic acid listed; the last column indicates whether the SNP is known or not; the presence of known SNPs in variant protein HUMEGFAA_PEA_2_P3 sequence provides support for the deduced sequence of this variant protein according to the present invention).

TABLE 75

Nucleic acid SNPs

| SNP position on nucleotide sequence | Alternative nucleic acid | Previously known SNP? |
|---|---|---|
| 82 | G → | No |
| 118 | G → | No |
| 407 | C → G | Yes |
| 431 | G → A | Yes |
| 465 | C → | No |
| 1034 | C → T | Yes |
| 1035 | G → T | No |
| 1036 | A → T | No |
| 1322 | T → C | No |
| 1405 | C → G | Yes |
| 1530 | C → T | Yes |
| 1828 | G → A | Yes |
| 1854 | A → T | No |
| 2122 | C → T | Yes |
| 2205 | A → G | No |
| 2729 | C → T | Yes |
| 2849 | C → T | Yes |
| 2972 | C → T | Yes |
| 2979 | G → A | Yes |
| 3050 | G → A | Yes |
| 3051 | G → A | Yes |
| 3166 | G → T | Yes |
| 3167 | T → C | Yes |
| 3178 | T → C | Yes |
| 3224 | A → T | Yes |
| 3563 | A → G | Yes |
| 3571 | G → | No |
| 3573 | T → | No |
| 3951 | C → G | Yes |
| 3953 | G → A | Yes |
| 3959 | C → T | Yes |
| 3960 | G → A | Yes |
| 4037 | C → T | Yes |
| 4042 | T → G | Yes |
| 4154 | → C | No |
| 4246 | C → T | Yes |
| 4398 | C → G | Yes |
| 4398 | C → T | Yes |
| 4589 | A → G | Yes |
| 4713 | C → T | Yes |
| 4766 | T → C | Yes |
| 4834 | T → C | Yes |
| 5094 | G → A | Yes |
| 5117 | C → T | Yes |
| 5121 | T → C | No |
| 5157 | G → A | Yes |
| 5157 | G → C | Yes |
| 6095 | T → A | Yes |
| 6096 | C → G | Yes |

TABLE 75-continued

Nucleic acid SNPs

| SNP position on nucleotide sequence | Alternative nucleic acid | Previously known SNP? |
|---|---|---|
| 6155 | G → C | Yes |
| 6160 | G → A | Yes |
| 6191 | G → C | Yes |
| 6300 | C → A | Yes |
| 6641 | C → T | Yes |
| 6679 | A → G | Yes |
| 6795 | G → T | Yes |
| 6963 | C → T | Yes |
| 7273 | C → G | Yes |
| 7365 | T → | No |
| 7533 | A → G | Yes |
| 7688 | C → T | Yes |
| 7829 | G → A | Yes |
| 7901 | G → A | No |
| 7901 | G → C | No |
| 7907 | C → T | No |
| 7943 | A → | No |
| 8117 | C → A | No |
| 8141 | C → T | Yes |
| 8656 | C → T | Yes |
| 8743 | G → | No |
| 8752 | C → | No |
| 8752 | C → G | No |
| 8817 | G → A | Yes |
| 8852 | C → T | Yes |
| 8870 | C → | No |
| 8870 | C → G | No |
| 8908 | T → | No |
| 8930 | G → A | Yes |
| 9046 | C → T | Yes |
| 9054 | C → | No |
| 9054 | C → T | No |
| 9198 | → T | No |
| 9293 | A → | No |
| 9327 | G → A | No |
| 9393 | G → A | Yes |
| 9396 | C → | No |
| 9470 | A → C | No |
| 9478 | T → | No |
| 9478 | T → A | No |
| 9500 | T → C | Yes |
| 9514 | → A | No |
| 9572 | A → C | No |
| 9800 | T → G | No |

The coding portion of transcript HUMEGFAA_PEA_2_T4 starts at position 1041 and ends at position 1469. The transcript also has the following SNPs as listed in Table 76 (given according to their position on the nucleotide sequence, with the alternative nucleic acid listed; the last column indicates whether the SNP is known or not; the presence of known SNPs in variant protein HUMEGFAA_PEA_2_P3 sequence provides support for the deduced sequence of this variant protein according to the present invention).

TABLE 76

Nucleic acid SNPs

| SNP position on nucleotide sequence | Alternative nucleic acid | Previously known SNP? |
|---|---|---|
| 82 | G → | No |
| 118 | G → | No |
| 407 | C → G | Yes |
| 431 | G → A | Yes |
| 465 | C → | No |
| 1034 | C → T | Yes |
| 1035 | G → T | No |
| 1036 | A → T | No |
| 1322 | T → C | No |

TABLE 76-continued

Nucleic acid SNPs

| SNP position on nucleotide sequence | Alternative nucleic acid | Previously known SNP? |
|---|---|---|
| 1405 | C → G | Yes |
| 1530 | C → T | Yes |
| 1828 | G → A | Yes |
| 1854 | A → T | No |
| 2122 | C → T | Yes |
| 2205 | A → G | No |
| 2729 | C → T | Yes |
| 2849 | C → T | Yes |
| 2972 | C → T | Yes |
| 2979 | G → A | Yes |
| 3050 | G → A | Yes |
| 3051 | G → A | Yes |
| 3166 | G → T | Yes |
| 3167 | T → C | Yes |
| 3178 | T → C | Yes |
| 3224 | A → T | Yes |
| 3563 | A → G | Yes |
| 3571 | G → | No |
| 3573 | T → | No |
| 3951 | C → G | Yes |
| 3953 | G → A | Yes |
| 3959 | C → T | Yes |
| 3960 | G → A | Yes |
| 4037 | C → T | Yes |
| 4042 | T → G | Yes |
| 4154 | → C | No |
| 4246 | C → T | Yes |
| 4398 | C → G | Yes |
| 4398 | C → T | Yes |
| 4589 | A → G | Yes |
| 4713 | C → T | Yes |
| 4766 | T → C | Yes |
| 4834 | T → C | Yes |
| 5094 | G → A | Yes |
| 5117 | C → T | Yes |
| 5121 | T → C | No |
| 5157 | G → A | Yes |
| 5157 | G → C | Yes |
| 5447 | G → A | No |
| 5447 | G → C | No |
| 5453 | C → T | No |
| 5489 | A → | No |
| 5663 | C → A | No |
| 5687 | C → T | Yes |
| 6202 | C → T | Yes |
| 6289 | G → | No |
| 6298 | C → | No |
| 6298 | C → G | No |
| 6363 | G → A | Yes |
| 6398 | C → T | Yes |
| 6416 | C → | No |
| 6416 | C → G | No |
| 6454 | T → | No |
| 6476 | G → A | Yes |
| 6592 | C → T | Yes |
| 6600 | C → | No |
| 6600 | C → T | No |
| 6744 | → T | No |
| 6839 | A → | No |
| 6873 | G → A | No |
| 6939 | G → A | Yes |
| 6942 | C → | No |
| 7016 | A → C | No |
| 7024 | T → | No |
| 7024 | T → A | No |
| 7046 | T → C | Yes |
| 7060 | → A | No |
| 7118 | A → C | No |
| 7346 | T → G | No |

The coding portion of transcript HUMEGFAA_PEA_2_T6 starts at position 1041 and ends at position 1469. The transcript also has the following SNPs as listed in Table 77 (given according to their position on the nucleotide sequence, with the alternative nucleic acid listed; the last column indicates whether the SNP is known or not; the presence of known SNPs in variant protein HUMEGFAA_PEA_2_P3 sequence provides support for the deduced sequence of this variant protein according to the present invention).

TABLE 77

Nucleic acid SNPs

| SNP position on nucleotide sequence | Alternative nucleic acid | Previously known SNP? |
|---|---|---|
| 82 | G → | No |
| 118 | G → | No |
| 407 | C → G | Yes |
| 431 | G → A | Yes |
| 465 | C → | No |
| 1034 | C → T | Yes |
| 1035 | G → T | No |
| 1036 | A → T | No |
| 1322 | T → C | No |
| 1405 | C → G | Yes |
| 1530 | C → T | Yes |
| 1828 | G → A | Yes |
| 1854 | A → T | No |
| 2122 | C → T | Yes |
| 2205 | A → G | No |
| 2729 | C → T | Yes |
| 2849 | C → T | Yes |
| 2972 | C → T | Yes |
| 2979 | G → A | Yes |
| 3050 | G → A | Yes |
| 3051 | G → A | Yes |
| 3166 | G → T | Yes |
| 3167 | T → C | Yes |
| 3178 | T → C | Yes |
| 3224 | A → T | Yes |
| 3563 | A → G | Yes |
| 3571 | G → | No |
| 3573 | T → | No |
| 3951 | C → G | Yes |
| 3953 | G → A | Yes |
| 3959 | C → T | Yes |
| 3960 | G → A | Yes |
| 4037 | C → T | Yes |
| 4042 | T → G | Yes |
| 4294 | G → A | No |
| 4294 | G → C | No |
| 4300 | C → T | No |
| 4336 | A → | No |
| 4510 | C → A | No |
| 4534 | C → T | Yes |
| 5049 | C → T | Yes |
| 5136 | G → | No |
| 5145 | C → | No |
| 5145 | C → G | No |
| 5210 | G → A | Yes |
| 5245 | C → T | Yes |
| 5263 | C → | No |
| 5263 | C → G | No |
| 5301 | T → | No |
| 5323 | G → A | Yes |
| 5439 | C → T | Yes |
| 5447 | C → | No |
| 5447 | C → T | No |
| 5591 | → T | No |
| 5686 | A → | No |
| 5720 | G → A | No |
| 5786 | G → A | Yes |
| 5789 | C → | No |
| 5863 | A → C | No |
| 5871 | T → | No |
| 5871 | T → A | No |
| 5893 | T → C | Yes |
| 5907 | → A | No |
| 5965 | A → C | No |
| 6193 | T → G | No |

The coding portion of transcript HUMEGFAA_PEA_2_T7 starts at position 1041 and ends at position 1469. The transcript also has the following SNPs as listed in Table 78 (given according to their position on the nucleotide sequence, with the alternative nucleic acid listed; the last column indicates whether the SNP is known or not; the presence of known SNPs in variant protein HUMEGFAA_PEA_2_P3 sequence provides support for the deduced sequence of this variant protein according to the present invention).

TABLE 78

Nucleic acid SNPs

| SNP position on nucleotide sequence | Alternative nucleic acid | Previously known SNP? |
|---|---|---|
| 82 | G → | No |
| 118 | G → | No |
| 407 | C → G | Yes |
| 431 | G → A | Yes |
| 465 | C → | No |
| 1034 | C → T | Yes |
| 1035 | G → T | No |
| 1036 | A → T | No |
| 1322 | T → C | No |
| 1405 | C → G | Yes |
| 1530 | C → T | Yes |
| 1828 | G → A | Yes |
| 1854 | A → T | No |
| 2122 | C → T | Yes |
| 2205 | A → G | No |
| 2435 | A → G | Yes |
| 2443 | G → | No |
| 2445 | T → | No |
| 2823 | C → G | Yes |
| 2825 | G → A | Yes |
| 2831 | C → T | Yes |
| 2832 | G → A | Yes |
| 2909 | C → T | Yes |
| 2914 | T → G | Yes |
| 3026 | → C | No |
| 3118 | C → T | Yes |
| 3270 | C → G | Yes |
| 3270 | C → T | Yes |
| 3461 | A → G | Yes |
| 3585 | C → T | Yes |
| 3638 | T → C | Yes |
| 3706 | T → C | Yes |
| 3966 | G → A | Yes |
| 3989 | C → T | Yes |
| 3993 | T → C | No |
| 4029 | G → A | Yes |
| 4029 | G → C | Yes |
| 4967 | T → A | Yes |
| 4968 | C → G | Yes |
| 5027 | G → C | Yes |
| 5032 | G → A | Yes |
| 5063 | G → C | Yes |
| 5172 | C → A | Yes |
| 5513 | C → T | Yes |
| 5551 | A → G | Yes |
| 5667 | G → T | Yes |
| 5835 | C → T | Yes |
| 6145 | C → G | Yes |
| 6237 | T → | No |
| 6405 | A → G | Yes |
| 6560 | C → T | Yes |
| 6701 | G → A | Yes |
| 6773 | G → A | No |
| 6773 | G → C | No |
| 6779 | C → T | No |
| 6815 | A → | No |
| 6989 | C → A | No |
| 7013 | C → T | Yes |
| 7528 | C → T | Yes |
| 7615 | G → | No |
| 7624 | C → | No |
| 7624 | C → G | No |
| 7689 | G → A | Yes |
| 7724 | C → T | Yes |
| 7742 | C → | No |

TABLE 78-continued

Nucleic acid SNPs

| SNP position on nucleotide sequence | Alternative nucleic acid | Previously known SNP? |
|---|---|---|
| 7742 | C → G | No |
| 7780 | T → | No |
| 7802 | G → A | Yes |
| 7918 | C → T | Yes |
| 7926 | C → | No |
| 7926 | C → T | No |
| 8070 | → T | No |
| 8165 | A → | No |
| 8199 | G → A | No |
| 8265 | G → A | Yes |
| 8268 | C → | No |
| 8342 | A → C | No |
| 8350 | T → | No |
| 8350 | T → A | No |
| 8372 | T → C | Yes |
| 8386 | → A | No |
| 8444 | A → C | No |
| 8672 | T → G | No |

The coding portion of transcript HUMEGFAA_PEA_2_T10 starts at position 1041 and ends at position 1469. The transcript also has the following SNPs as listed in Table 79 (given according to their position on the nucleotide sequence, with the alternative nucleic acid listed; the last column indicates whether the SNP is known or not; the presence of known SNPs in variant protein HUMEGFAA_PEA_2_P3 sequence provides support for the deduced sequence of this variant protein according to the present invention).

TABLE 79

Nucleic acid SNPs

| SNP position on nucleotide sequence | Alternative nucleic acid | Previously known SNP? |
|---|---|---|
| 82 | G → | No |
| 118 | G → | No |
| 407 | C → G | Yes |
| 431 | G → A | Yes |
| 465 | C → | No |
| 1034 | C → T | Yes |
| 1035 | G → T | No |
| 1036 | A → T | No |
| 1322 | T → C | No |
| 1405 | C → G | Yes |
| 1530 | C → T | Yes |
| 1828 | G → A | Yes |
| 1854 | A → T | No |
| 2122 | C → T | Yes |
| 2205 | A → G | No |
| 2729 | C → T | Yes |
| 2849 | C → T | Yes |
| 2972 | C → T | Yes |
| 2979 | G → A | Yes |
| 3050 | G → A | Yes |
| 3051 | G → A | Yes |
| 3166 | G → T | Yes |
| 3167 | T → C | Yes |
| 3178 | T → C | Yes |
| 3224 | A → T | Yes |
| 3563 | A → G | Yes |
| 3571 | G → | No |
| 3573 | T → | No |
| 3951 | C → G | Yes |
| 3953 | G → A | Yes |
| 3959 | C → T | Yes |
| 3960 | G → A | Yes |
| 4037 | C → T | Yes |
| 4042 | T → G | Yes |
| 4276 | G → A | No |

TABLE 79-continued

Nucleic acid SNPs

| SNP position on nucleotide sequence | Alternative nucleic acid | Previously known SNP? |
|---|---|---|
| 4276 | G → C | No |
| 4282 | C → T | No |
| 4318 | A → | No |
| 4492 | C → A | No |
| 4516 | C → T | Yes |
| 5031 | C → T | Yes |
| 5118 | G → | No |
| 5127 | C → | No |
| 5127 | C → G | No |
| 5192 | G → A | Yes |
| 5227 | C → T | Yes |
| 5245 | C → | No |
| 5245 | C → G | No |
| 5283 | T → | No |
| 5305 | G → A | Yes |
| 5421 | C → T | Yes |
| 5429 | C → | No |
| 5429 | C → T | No |
| 5573 | → T | No |
| 5668 | A → | No |
| 5702 | G → A | No |
| 5768 | G → A | Yes |
| 5771 | C → | No |
| 5845 | A → C | No |
| 5853 | T → | No |
| 5853 | T → A | No |
| 5875 | T → C | Yes |
| 5889 | → A | No |
| 5947 | A → C | No |
| 6175 | T → G | No |

The coding portion of transcript HUMEGFAA_PEA_2_T11 starts at position 1041 and ends at position 1469. The transcript also has the following SNPs as listed in Table 80 (given according to their position on the nucleotide sequence, with the alternative nucleic acid listed; the last column indicates whether the SNP is known or not; the presence of known SNPs in variant protein HUMEGFAA_PEA_2_P3 sequence provides support for the deduced sequence of this variant protein according to the present invention).

TABLE 80

Nucleic acid SNPs

| SNP position on nucleotide sequence | Alternative nucleic acid | Previously known SNP? |
|---|---|---|
| 82 | G → | No |
| 118 | G → | No |
| 407 | C → G | Yes |
| 431 | G → A | Yes |
| 465 | C → | No |
| 1034 | C → T | Yes |
| 1035 | G → T | No |
| 1036 | A → T | No |
| 1322 | T → C | No |
| 1405 | C → G | Yes |
| 1530 | C → T | Yes |
| 1828 | G → A | Yes |
| 1854 | A → T | No |
| 2122 | C → T | Yes |
| 2205 | A → G | No |
| 2729 | C → T | Yes |
| 2849 | C → T | Yes |
| 2972 | C → T | Yes |
| 2979 | G → A | Yes |
| 3050 | G → A | Yes |
| 3051 | G → A | Yes |
| 3166 | G → T | Yes |
| 3167 | T → C | Yes |

TABLE 80-continued

Nucleic acid SNPs

| SNP position on nucleotide sequence | Alternative nucleic acid | Previously known SNP? |
|---|---|---|
| 3178 | T → C | Yes |
| 3224 | A → T | Yes |
| 3563 | A → G | Yes |
| 3571 | G → | No |
| 3573 | T → | No |
| 3951 | C → G | Yes |
| 3953 | G → A | Yes |
| 3959 | C → T | Yes |
| 3960 | G → A | Yes |
| 4037 | C → T | Yes |
| 4042 | T → G | Yes |
| 4162 | G → A | No |
| 4162 | G → C | No |
| 4168 | C → T | No |
| 4204 | A → | No |
| 4378 | C → A | No |
| 4402 | C → T | Yes |
| 4917 | C → T | Yes |
| 5004 | G → | No |
| 5013 | C → | No |
| 5013 | C → G | No |
| 5078 | G → A | Yes |
| 5113 | C → T | Yes |
| 5131 | C → | No |
| 5131 | C → G | No |
| 5169 | T → | No |
| 5191 | G → A | Yes |
| 5307 | C → T | Yes |
| 5315 | C → | No |
| 5315 | C → T | No |
| 5459 | → T | No |
| 5554 | A → | No |
| 5588 | G → A | No |
| 5654 | G → A | Yes |
| 5657 | C → | No |
| 5731 | A → C | No |
| 5739 | T → | No |
| 5739 | T → A | No |
| 5761 | T → C | Yes |
| 5775 | → A | No |
| 5833 | A → C | No |
| 6061 | T → G | No |

The coding portion of transcript HUMEGFAA_PEA_2_T13 starts at position 1041 and ends at position 1469. The transcript also has the following SNPs as listed in Table 81 (given according to their position on the nucleotide sequence, with the alternative nucleic acid listed; the last column indicates whether the SNP is known or not; the presence of known SNPs in variant protein HUMEGFAA_PEA_2_P3 sequence provides support for the deduced sequence of this variant protein according to the present invention).

TABLE 81

Nucleic acid SNPs

| SNP position on nucleotide sequence | Alternative nucleic acid | Previously known SNP? |
|---|---|---|
| 82 | G → | No |
| 118 | G → | No |
| 407 | C → G | Yes |
| 431 | G → A | Yes |
| 465 | C → | No |
| 1034 | C → T | Yes |
| 1035 | G → T | No |
| 1036 | A → T | No |
| 1322 | T → C | No |
| 1405 | C → G | Yes |
| 1530 | C → T | Yes |

TABLE 81-continued

Nucleic acid SNPs

| SNP position on nucleotide sequence | Alternative nucleic acid | Previously known SNP? |
|---|---|---|
| 1828 | G → A | Yes |
| 1854 | A → T | No |
| 2122 | C → T | Yes |
| 2205 | A → G | No |
| 3055 | T → A | Yes |
| 3056 | C → G | Yes |
| 3115 | G → C | Yes |
| 3120 | G → A | Yes |
| 3151 | G → C | Yes |
| 3260 | C → A | Yes |
| 3601 | C → T | Yes |
| 3639 | A → G | Yes |
| 3755 | G → T | Yes |
| 3923 | C → T | Yes |
| 4233 | C → G | Yes |
| 4325 | T → | No |
| 4493 | A → G | Yes |
| 4648 | C → T | Yes |
| 4789 | G → A | Yes |
| 4861 | G → A | No |
| 4861 | G → C | No |
| 4867 | C → T | No |
| 4903 | A → | No |
| 5077 | C → A | No |
| 5101 | C → T | Yes |
| 5616 | C → T | Yes |
| 5703 | G → | No |
| 5712 | C → | No |
| 5712 | C → G | No |
| 5777 | G → A | Yes |
| 5812 | C → T | Yes |
| 5830 | C → | No |
| 5830 | C → G | No |
| 5868 | T → | No |
| 5890 | G → A | Yes |
| 6006 | C → T | Yes |
| 6014 | C → | No |
| 6014 | C → T | No |
| 6158 | → T | No |
| 6253 | A → | No |
| 6287 | G → A | No |
| 6353 | G → A | Yes |
| 6356 | C → | No |
| 6430 | A → C | No |
| 6438 | T → | No |
| 6438 | T → A | No |
| 6460 | T → C | Yes |
| 6474 | → A | No |
| 6532 | A → C | No |
| 6760 | T → G | No |

The coding portion of transcript HUMEGFAA_PEA_2_T16 starts at position 1041 and ends at position 1469. The transcript also has the following SNPs as listed in Table 82 (given according to their position on the nucleotide sequence, with the alternative nucleic acid listed; the last column indicates whether the SNP is known or not; the presence of known SNPs in variant protein HUMEGFAA_PEA_2_P3 sequence provides support for the deduced sequence of this variant protein according to the present invention).

TABLE 82

Nucleic acid SNPs

| SNP position on nucleotide sequence | Alternative nucleic acid | Previously known SNP? |
|---|---|---|
| 82 | G → | No |
| 118 | G → | No |
| 407 | C → G | Yes |

TABLE 82-continued

Nucleic acid SNPs

| SNP position on nucleotide sequence | Alternative nucleic acid | Previously known SNP? |
|---|---|---|
| 431 | G → A | Yes |
| 465 | C → | No |
| 1034 | C → T | Yes |
| 1035 | G → T | No |
| 1036 | A → T | No |
| 1322 | T → C | No |
| 1405 | C → G | Yes |
| 1530 | C → T | Yes |
| 1828 | G → A | Yes |
| 1854 | A → T | No |
| 2122 | C → T | Yes |
| 2205 | A → G | No |
| 3127 | T → A | Yes |
| 3128 | C → G | Yes |
| 3187 | G → C | Yes |
| 3192 | G → A | Yes |
| 3223 | G → C | Yes |
| 3332 | C → A | Yes |
| 3673 | C → T | Yes |
| 3711 | A → G | Yes |
| 3827 | G → T | Yes |
| 3995 | C → T | Yes |
| 4305 | C → G | Yes |
| 4397 | T → | No |
| 4565 | A → G | Yes |
| 4720 | C → T | Yes |
| 4861 | G → A | Yes |
| 4933 | G → A | No |
| 4933 | G → C | No |
| 4939 | C → T | No |
| 4975 | A → | No |
| 5149 | C → A | No |
| 5173 | C → T | Yes |
| 5688 | C → T | Yes |
| 5775 | G → | No |
| 5784 | C → | No |
| 5784 | C → G | No |
| 5849 | G → A | Yes |
| 5884 | C → T | Yes |
| 5902 | C → | No |
| 5902 | C → G | No |
| 5940 | T → | No |
| 5962 | G → A | Yes |
| 6078 | C → T | Yes |
| 6086 | C → | No |
| 6086 | C → T | No |
| 6230 | → T | No |
| 6325 | A → | No |
| 6359 | G → A | No |
| 6425 | G → A | Yes |
| 6428 | C → | No |
| 6502 | A → C | No |
| 6510 | T → | No |
| 6510 | T → A | No |
| 6532 | T → C | Yes |
| 6546 | → A | No |
| 6604 | A → C | No |
| 6832 | T → G | No |

The coding portion of transcript HUMEGFAA_PEA_2_T17 starts at position 1041 and ends at position 1469. The transcript also has the following SNPs as listed in Table 83 (given according to their position on the nucleotide sequence, with the alternative nucleic acid listed; the last column indicates whether the SNP is known or not; the presence of known SNPs in variant protein HUMEGFAA_PEA_2_P3 sequence provides support for the deduced sequence of this variant protein according to the present invention).

TABLE 83

Nucleic acid SNPs

| SNP position on nucleotide sequence | Alternative nucleic acid | Previously known SNP? |
|---|---|---|
| 82 | G → | No |
| 118 | G → | No |
| 407 | C → G | Yes |
| 431 | G → A | Yes |
| 465 | C → | No |
| 1034 | C → T | Yes |
| 1035 | G → T | No |
| 1036 | A → T | No |
| 1322 | T → C | No |
| 1405 | C → G | Yes |
| 1530 | C → T | Yes |
| 1828 | G → A | Yes |
| 1854 | A → T | No |
| 2122 | C → T | Yes |
| 2205 | A → G | No |
| 2275 | G → A | No |
| 2275 | G → C | No |
| 2281 | C → T | No |
| 2317 | A → | No |
| 2491 | C → A | No |
| 2515 | C → T | Yes |
| 3030 | C → T | Yes |
| 3117 | G → | No |
| 3126 | C → | No |
| 3126 | C → G | No |
| 3191 | G → A | Yes |
| 3226 | C → T | Yes |
| 3244 | C → | No |
| 3244 | C → G | No |
| 3282 | T → | No |
| 3304 | G → A | Yes |
| 3420 | C → T | Yes |
| 3428 | C → | No |
| 3428 | C → T | No |
| 3572 | → T | No |
| 3667 | A → | No |
| 3701 | G → A | No |
| 3767 | G → A | Yes |
| 3770 | C → | No |
| 3844 | A → C | No |
| 3852 | T → | No |
| 3852 | T → A | No |
| 3874 | T → C | Yes |
| 3888 | → A | No |
| 3946 | A → C | No |
| 4174 | T → G | No |

The coding portion of transcript HUMEGFAA_PEA_2_T19 starts at position 1041 and ends at position 1469. The transcript also has the following SNPs as listed in Table 84 (given according to their position on the nucleotide sequence, with the alternative nucleic acid listed; the last column indicates whether the SNP is known or not; the presence of known SNPs in variant protein HUMEGFAA_PEA_2_P3 sequence provides support for the deduced sequence of this variant protein according to the present invention).

TABLE 84

Nucleic acid SNPs

| SNP position on nucleotide sequence | Alternative nucleic acid | Previously known SNP? |
|---|---|---|
| 82 | G → | No |
| 118 | G → | No |
| 407 | C → G | Yes |
| 431 | G → A | Yes |
| 465 | C → | No |
| 1034 | C → T | Yes |
| 1035 | G → T | No |

TABLE 84-continued

Nucleic acid SNPs

| SNP position on nucleotide sequence | Alternative nucleic acid | Previously known SNP? |
|---|---|---|
| 1036 | A → T | No |
| 1322 | T → C | No |
| 1405 | C → G | Yes |
| 1530 | C → T | Yes |
| 1828 | G → A | Yes |
| 1854 | A → T | No |
| 2122 | C → T | Yes |
| 2205 | A → G | No |
| 2407 | G → A | No |
| 2407 | G → C | No |
| 2413 | C → T | No |
| 2449 | A → | No |
| 2623 | C → A | No |
| 2647 | C → T | Yes |
| 3162 | C → T | Yes |
| 3249 | G → | No |
| 3258 | C → | No |
| 3258 | C → G | No |
| 3323 | G → A | Yes |
| 3358 | C → T | Yes |
| 3376 | C → | No |
| 3376 | C → G | No |
| 3414 | T → | No |
| 3436 | G → A | Yes |
| 3552 | C → T | Yes |
| 3560 | C → | No |
| 3560 | C → T | No |
| 3704 | → T | No |
| 3799 | A → | No |
| 3833 | G → A | No |
| 3899 | G → A | Yes |
| 3902 | C → | No |
| 3976 | A → C | No |
| 3984 | T → | No |
| 3984 | T → A | No |
| 4006 | T → C | Yes |
| 4020 | → A | No |
| 4078 | A → C | No |
| 4306 | T → G | No |

The coding portion of transcript HUMEGFAA_PEA_2_T21 starts at position 1041 and ends at position 1469. The transcript also has the following SNPs as listed in Table 85 (given according to their position on the nucleotide sequence, with the alternative nucleic acid listed; the last column indicates whether the SNP is known or not; the presence of known SNPs in variant protein HUMEGFAA_PEA_2_P3 sequence provides support for the deduced sequence of this variant protein according to the present invention).

TABLE 85

Nucleic acid SNPs

| SNP position on nucleotide sequence | Alternative nucleic acid | Previously known SNP? |
|---|---|---|
| 82 | G → | No |
| 118 | G → | No |
| 407 | C → G | Yes |
| 431 | G → A | Yes |
| 465 | C → | No |
| 1034 | C → T | Yes |
| 1035 | G → T | No |
| 1036 | A → T | No |
| 1322 | T → C | No |
| 1405 | C → G | Yes |
| 1530 | C → T | Yes |
| 1828 | G → A | Yes |
| 1854 | A → T | No |
| 2122 | C → T | Yes |

TABLE 85-continued

Nucleic acid SNPs

| SNP position on nucleotide sequence | Alternative nucleic acid | Previously known SNP? |
|---|---|---|
| 2205 | A → G | No |
| 2479 | G → A | No |
| 2479 | G → C | No |
| 2485 | C → T | No |
| 2521 | A → | No |
| 2695 | C → A | No |
| 2719 | C → T | Yes |
| 3234 | C → T | Yes |
| 3321 | G → | No |
| 3330 | C → | No |
| 3330 | C → G | No |
| 3395 | G → A | Yes |
| 3430 | C → T | Yes |
| 3448 | C → | No |
| 3448 | C → G | No |
| 3486 | T → | No |
| 3508 | G → A | Yes |
| 3624 | C → T | Yes |
| 3632 | C → | No |
| 3632 | C → T | No |
| 3776 | → T | No |
| 3871 | A → | No |
| 3905 | G → A | No |
| 3971 | G → A | Yes |
| 3974 | C → | No |
| 4048 | A → C | No |
| 4056 | T → | No |
| 4056 | T → A | No |
| 4078 | T → C | Yes |
| 4092 | → A | No |
| 4150 | A → C | No |
| 4378 | T → G | No |

The coding portion of transcript HUMEGFAA_PEA_2_T22 starts at position 1041 and ends at position 1469. The transcript also has the following SNPs as listed in Table 86 (given according to their position on the nucleotide sequence, with the alternative nucleic acid listed; the last column indicates whether the SNP is known or not; the presence of known SNPs in variant protein HUMEGFAA_PEA_2_P3 sequence provides support for the deduced sequence of this variant protein according to the present invention).

TABLE 86

Nucleic acid SNPs

| SNP position on nucleotide sequence | Alternative nucleic acid | Previously known SNP? |
|---|---|---|
| 82 | G → | No |
| 118 | G → | No |
| 407 | C → G | Yes |
| 431 | G → A | Yes |
| 465 | C → | No |
| 1034 | C → T | Yes |
| 1035 | G → T | No |
| 1036 | A → T | No |
| 1322 | T → C | No |
| 1405 | C → G | Yes |
| 1530 | C → T | Yes |
| 1828 | G → A | Yes |
| 1854 | A → T | No |
| 2122 | C → T | Yes |
| 2205 | A → G | No |
| 2461 | G → A | No |
| 2461 | G → C | No |
| 2467 | C → T | No |
| 2503 | A → | No |
| 2677 | C → A | No |
| 2701 | C → T | Yes |

TABLE 86-continued

Nucleic acid SNPs

| SNP position on nucleotide sequence | Alternative nucleic acid | Previously known SNP? |
|---|---|---|
| 3216 | C → T | Yes |
| 3303 | G → | No |
| 3312 | C → | No |
| 3312 | C → G | No |
| 3377 | G → A | Yes |
| 3412 | C → T | Yes |
| 3430 | C → | No |
| 3430 | C → G | No |
| 3468 | T → | No |
| 3490 | G → A | Yes |
| 3606 | C → T | Yes |
| 3614 | C → | No |
| 3614 | C → T | No |
| 3758 | → T | No |
| 3853 | A → | No |
| 3887 | G → A | No |
| 3953 | G → A | Yes |
| 3956 | C → | No |
| 4030 | A → C | No |
| 4038 | T → | No |
| 4038 | T → A | No |
| 4060 | T → C | Yes |
| 4074 | → A | No |
| 4132 | A → C | No |
| 4360 | T → G | No |

The coding portion of transcript HUMEGFAA_PEA_2_T25 starts at position 1041 and ends at position 1469. The transcript also has the following SNPs as listed in Table 87 (given according to their position on the nucleotide sequence, with the alternative nucleic acid listed; the last column indicates whether the SNP is known or not; the presence of known SNPs in variant protein HUMEGFAA_PEA_2_P3 sequence provides support for the deduced sequence of this variant protein according to the present invention).

TABLE 87

Nucleic acid SNPs

| SNP position on nucleotide sequence | Alternative nucleic acid | Previously known SNP? |
|---|---|---|
| 82 | G → | No |
| 118 | G → | No |
| 407 | C → G | Yes |
| 431 | G → A | Yes |
| 465 | C → | No |
| 1034 | C → T | Yes |
| 1035 | G → T | No |
| 1036 | A → T | No |
| 1322 | T → C | No |
| 1405 | C → G | Yes |
| 1530 | C → T | Yes |
| 1828 | G → A | Yes |
| 1854 | A → T | No |
| 2122 | C → T | Yes |
| 2205 | A → G | No |
| 2425 | G → A | No |
| 2425 | G → C | No |
| 2431 | C → T | No |
| 2467 | A → | No |
| 2641 | C → A | No |
| 2665 | C → T | Yes |
| 3180 | C → T | Yes |
| 3267 | G → | No |
| 3276 | C → | No |
| 3276 | C → G | No |
| 3341 | G → A | Yes |
| 3376 | C → T | Yes |
| 3394 | C → | No |

TABLE 87-continued

Nucleic acid SNPs

| SNP position on nucleotide sequence | Alternative nucleic acid | Previously known SNP? |
|---|---|---|
| 3394 | C → G | No |
| 3432 | T → | No |
| 3454 | G → A | Yes |
| 3570 | C → T | Yes |
| 3578 | C → | No |
| 3578 | C → T | No |
| 3722 | → T | No |
| 3817 | A → | No |
| 3851 | G → A | No |
| 3917 | G → A | Yes |
| 3920 | C → | No |
| 3994 | A → C | No |
| 4002 | T → | No |
| 4002 | T → A | No |
| 4024 | T → C | Yes |
| 4038 | → A | No |
| 4096 | A → C | No |
| 4324 | T → G | No |

The coding portion of transcript HUMEGFAA_PEA_2_T29 starts at position 1041 and ends at position 1469. The transcript also has the following SNPs as listed in Table 88 (given according to their position on the nucleotide sequence, with the alternative nucleic acid listed; the last column indicates whether the SNP is known or not; the presence of known SNPs in variant protein HUMEGFAA_PEA_2_P3 sequence provides support for the deduced sequence of this variant protein according to the present invention).

TABLE 88

Nucleic acid SNPs

| SNP position on nucleotide sequence | Alternative nucleic acid | Previously known SNP? |
|---|---|---|
| 82 | G → | No |
| 118 | G → | No |
| 407 | C → G | Yes |
| 431 | G → A | Yes |
| 465 | C → | No |
| 1034 | C → T | Yes |
| 1035 | G → T | No |
| 1036 | A → T | No |
| 1322 | T → C | No |
| 1405 | C → G | Yes |
| 1530 | C → T | Yes |
| 1828 | G → A | Yes |
| 1854 | A → T | No |
| 2122 | C → T | Yes |
| 2205 | A → G | No |
| 2729 | C → T | Yes |
| 2849 | C → T | Yes |
| 2972 | C → T | Yes |
| 2979 | G → A | Yes |
| 3050 | G → A | Yes |
| 3051 | G → A | Yes |
| 3166 | G → T | Yes |
| 3167 | T → C | Yes |
| 3178 | T → C | Yes |
| 3224 | A → T | Yes |
| 3563 | A → G | Yes |
| 3571 | G → | No |
| 3573 | T → | No |
| 3951 | C → G | Yes |
| 3953 | G → A | Yes |
| 3959 | C → T | Yes |
| 3960 | G → A | Yes |
| 4037 | C → T | Yes |
| 4042 | T → G | Yes |
| 4154 | → C | No |
| 4246 | C → T | Yes |
| 4398 | C → G | Yes |
| 4398 | C → T | Yes |
| 4589 | A → G | Yes |
| 4713 | C → T | Yes |
| 4766 | T → C | Yes |
| 4834 | T → C | Yes |
| 5094 | G → A | Yes |
| 5117 | C → T | Yes |
| 5121 | T → C | No |
| 5157 | G → A | Yes |
| 5157 | G → C | Yes |
| 6095 | T → A | Yes |
| 6096 | C → G | Yes |
| 6155 | G → C | Yes |
| 6160 | G → A | Yes |
| 6191 | G → C | Yes |
| 6300 | C → A | Yes |
| 6641 | C → T | Yes |
| 6679 | A → G | Yes |
| 6795 | G → T | Yes |
| 6963 | C → T | Yes |
| 7273 | C → G | Yes |
| 7365 | T → | No |
| 7533 | A → G | Yes |
| 7688 | C → T | Yes |
| 7829 | G → A | Yes |
| 7901 | G → A | No |
| 7901 | G → C | No |
| 7907 | C → T | No |
| 7943 | A → | No |
| 8117 | C → A | No |
| 8141 | C → T | Yes |
| 8656 | C → T | Yes |
| 8743 | G → | No |
| 8752 | C → | No |
| 8752 | C → G | No |
| 8817 | G → A | Yes |
| 8852 | C → T | Yes |
| 8870 | C → | No |
| 8870 | C → G | No |
| 8908 | T → | No |
| 8930 | G → A | Yes |
| 9046 | C → T | Yes |
| 9054 | C → | No |
| 9054 | C → T | No |
| 9198 | → T | No |
| 9293 | A → | No |
| 9327 | G → A | No |
| 9393 | G → A | Yes |
| 9396 | C → | No |
| 9470 | A → C | No |
| 9478 | T → | No |
| 9478 | T → A | No |
| 9500 | T → C | Yes |
| 9514 | → A | No |
| 9572 | A → C | No |

The coding portion of transcript HUMEGFAA_PEA_2_T43 starts at position 1041 and ends at position 1469. The transcript also has the following SNPs as listed in Table 89 (given according to their position on the nucleotide sequence, with the alternative nucleic acid listed; the last column indicates whether the SNP is known or not; the presence of known SNPs in variant protein HUMEGFAA_PEA_2_P3 sequence provides support for the deduced sequence of this variant protein according to the present invention).

TABLE 89

| Nucleic acid SNPs | | |
|---|---|---|
| SNP position on nucleotide sequence | Alternative nucleic acid | Previously known SNP? |
| 82 | G → | No |
| 118 | G → | No |
| 407 | C → G | Yes |
| 431 | G → A | Yes |
| 465 | C → | No |
| 1034 | C → T | Yes |
| 1035 | G → T | No |
| 1036 | A → T | No |
| 1322 | T → C | No |
| 1405 | C → G | Yes |
| 1530 | C → T | Yes |
| 1828 | G → A | Yes |
| 1854 | A → T | No |
| 2122 | C → T | Yes |
| 2205 | A → G | No |
| 2282 | G → A | Yes |
| 2317 | C → T | Yes |
| 2363 | C → T | Yes |
| 2376 | A → G | Yes |
| 2424 | T → G | Yes |
| 2442 | A → G | Yes |

Variant protein HUMEGFAA_PEA_2_P14 according to the present invention is encoded by transcript(s) HUMEGFAA_PEA_2_T44. An alignment is given to the known protein (Vascular endothelial growth factor A precursor) in FIG. 153. A brief description of the relationship of the variant protein according to the present invention to each such aligned protein is as follows:

Comparison Report Between HUMEGFAA_PEA_2_P14 and VEGA_HUMAN:

1. An isolated chimeric polypeptide HUMEGFAA_PEA_2_P14, comprising a first amino acid sequence being at least 90% homologous to MNFLLSWVHWSLALLLYLHHAK-WSQAAPMAEGGGQNHHEVVKFMDVYQR SYCHPI-ETLVDIFQEYPDEIEYIFKPSCVPLM-RCGGCCNDEGLECVPTEESNITM QIMRIKPHQGQHIGEMSFLQHNKCECR corresponding to amino acids 1-131 of VEGA_HUMAN, which also corresponds to amino acids 1-131 of HUMEGFAA_PEA_2_P14.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMEGFAA_PEA_2_P14 also has the following non-silent SNPs (Single Nucleotide Polymorphisms) as listed in Table 90, (given according to their position(s) on the amino acid sequence, with the alternative amino acid(s) listed; the last column indicates whether the SNP is known or not; the presence of known SNPs in variant protein HUMEGFAA_PEA_2_P14 sequence provides support for the deduced sequence of this variant protein according to the present invention).

TABLE 90

| Amino acid mutations | | |
|---|---|---|
| SNP position(s) on amino acid sequence | Alternative amino acid(s) | Previously known SNP? |
| 124 | Q → R | No |

The glycosylation sites of variant protein HUMEGFAA_PEA_2_P14, as compared to the known protein Vascular endothelial growth factor A precursor, are described in Table 91 (given according to their position(s) on the amino acid sequence in the first column; the second column indicates whether the glycosylation site is present in the variant protein; and the last column indicates whether the position is different on the variant protein).

TABLE 91

| Glycosylation site(s) | | |
|---|---|---|
| Position(s) on known amino acid sequence | Present in variant protein? | Position in variant protein? |
| 101 | yes | 101 |

The variant protein has the following domains, as determined by using InterPro. The domains are described in Table 92, hereinbelow.

TABLE 92

| InterPro domain(s) | | | |
|---|---|---|---|
| InterPro ID | Domain description | Analysis type | Position(s) on protein |
| IPR002400 | Growth factor, cystine knot | FPrintScan | 126-130, 79-88 |
| IPR000072 | Platelet-derived growth factor (PDGF) | HMMPfam | 52-130 |
| IPR000072 | Platelet-derived growth factor (PDGF) | HMMSmart | 50-131 |
| IPR000072 | Platelet-derived growth factor (PDGF) | ScanRegExp | 75-87 |
| IPR000072 | Platelet-derived growth factor (PDGF) | BlastProDom | 43-129 |
| IPR000072 | Platelet-derived growth factor (PDGF) | ProfileScan | 39-131 |

Variant protein HUMEGFAA_PEA_2_P14 is encoded by the following transcript(s): HUMEGFAA_PEA_2_T44. The coding portion of transcript HUMEGFAA_PEA_2_T44 starts at position 1041 and ends at position 1433. The transcript also has the following SNPs as listed in Table 93 (given according to their position on the nucleotide sequence, with the alternative nucleic acid listed; the last column indicates whether the SNP is known or not; the presence of known SNPs in variant protein HUMEGFAA_PEA_2_P14 sequence provides support for the deduced sequence of this variant protein according to the present invention).

TABLE 93

| Nucleic acid SNPs | | |
|---|---|---|
| SNP position on nucleotide sequence | Alternative nucleic acid | Previously known SNP? |
| 82 | G → | No |
| 118 | G → | No |

TABLE 93-continued

Nucleic acid SNPs

| SNP position on nucleotide sequence | Alternative nucleic acid | Previously known SNP? |
|---|---|---|
| 407 | C → G | Yes |
| 431 | G → A | Yes |
| 465 | C → | No |
| 1034 | C → T | Yes |
| 1035 | G → T | No |
| 1036 | A → T | No |
| 1322 | T → C | No |
| 1411 | A → G | No |
| 1488 | G → A | Yes |
| 1523 | C → T | Yes |
| 1569 | C → T | Yes |
| 1582 | A → G | Yes |
| 1630 | T → G | Yes |
| 1648 | A → G | Yes |

Figure 35:
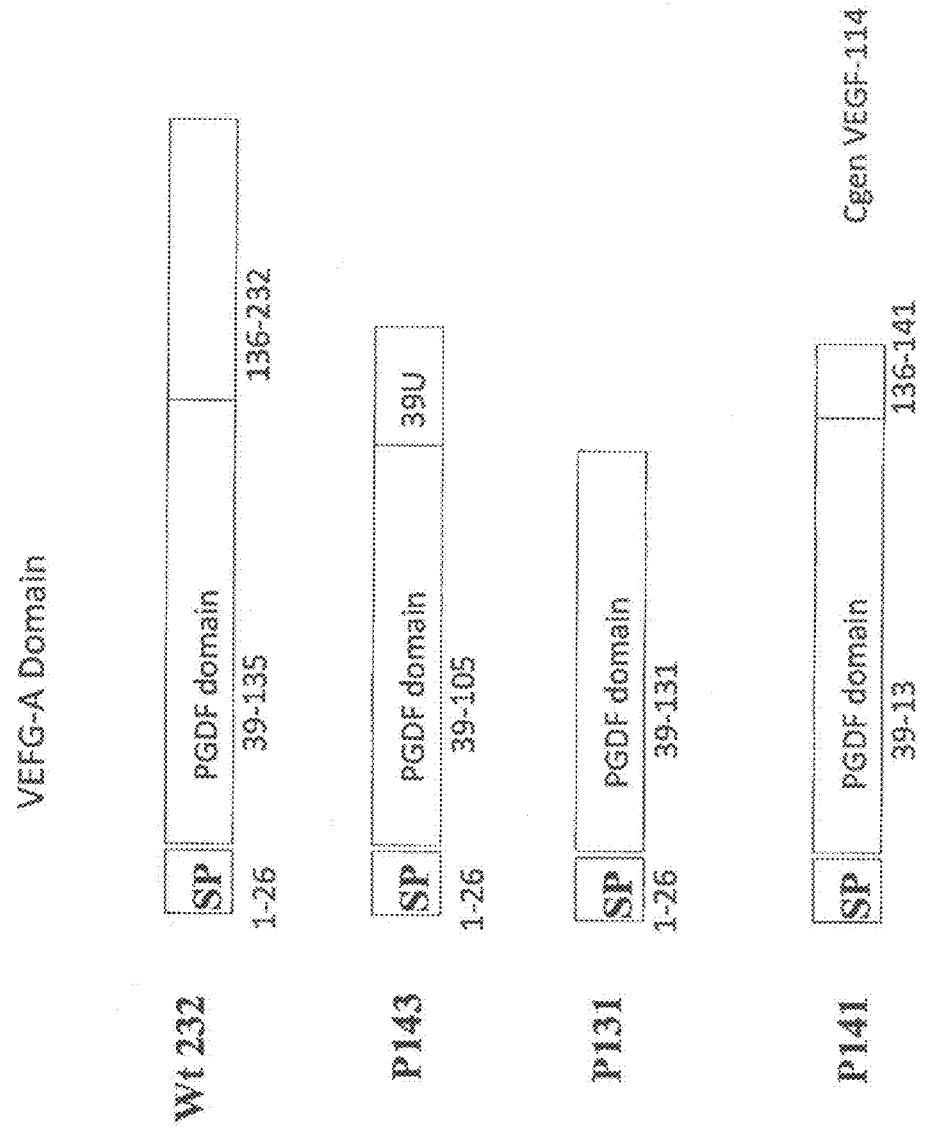
FIG. 35 depicts the structure domain of the variants described in Example 49 in comparison to the known or wild-type (WT) protein.

The variants were found to have the following domain structure as shown in the FIG. 35 in comparison to the known or wild-type (WT) protein.

Example 50

Description for Cluster HSFLT

Cluster HSFLT features 8 transcript(s) and 25 segment(s) of interest, the names for which are given in Tables 94 and 95, respectively, the sequences themselves are given in SEQ ID NOs: 497-504; 505-529 and 531-537, for transcripts, segments and proteins, respectively. The selected protein variants are given in Table 96.

TABLE 94

Transcripts of interest

| Transcript Name | SEQ ID NO: |
|---|---|
| HSFLT_PEA_1_T4 | 497 |
| HSFLT_PEA_1_T5 | 498 |
| HSFLT_PEA_1_T13 | 499 |
| HSFLT_PEA_1_T15 | 500 |
| HSFLT_PEA_1_T16 | 501 |
| HSFLT_PEA_1_T17 | 502 |
| HSFLT_PEA_1_T19 | 503 |
| HSFLT_PEA_1_T25 | 504 |

TABLE 95

Segments of interest

| Segment Name | SEQ ID NO: |
|---|---|
| HSFLT_PEA_1_node_0 | 505 |
| HSFLT_PEA_1_node_8 | 506 |
| HSFLT_PEA_1_node_11 | 507 |
| HSFLT_PEA_1_node_15 | 508 |
| HSFLT_PEA_1_node_17 | 509 |
| HSFLT_PEA_1_node_19 | 510 |
| HSFLT_PEA_1_node_20 | 511 |
| HSFLT_PEA_1_node_24 | 512 |
| HSFLT_PEA_1_node_26 | 513 |
| HSFLT_PEA_1_node_33 | 514 |
| HSFLT_PEA_1_node_42 | 515 |
| HSFLT_PEA_1_node_43 | 516 |
| HSFLT_PEA_1_node_44 | 517 |
| HSFLT_PEA_1_node_46 | 518 |
| HSFLT_PEA_1_node_47 | 519 |
| HSFLT_PEA_1_node_49 | 520 |
| HSFLT_PEA_1_node_51 | 521 |
| HSFLT_PEA_1_node_1 | 522 |
| HSFLT_PEA_1_node_3 | 523 |
| HSFLT_PEA_1_node_6 | 524 |
| HSFLT_PEA_1_node_22 | 525 |
| HSFLT_PEA_1_node_28 | 526 |
| HSFLT_PEA_1_node_35 | 527 |
| HSFLT_PEA_1_node_37 | 528 |
| HSFLT_PEA_1_node_39 | 529 |

TABLE 96

Proteins of interest

| Protein Name | SEQ ID NO: | Protein Length | Corresponding Transcript(s) |
|---|---|---|---|
| HSFLT_PEA_1_P3 | 531 | P567 | HSFLT_PEA_1_T4 |
| HSFLT_PEA_1_P4 | 532 | P541 | HSFLT_PEA_1_T5 |
| HSFLT_PEA_1_P10 | 533 | P733 | HSFLT_PEA_1_T13 |
| HSFLT_PEA_1_P12 | 534 | P718 | HSFLT_PEA_1_T15; HSFLT_PEA_1_T17 |
| HSFLT_PEA_1_P13 | 535 | P736 | HSFLT_PEA_1_T16 |
| HSFLT_PEA_1_P14 | 536 | P547 | HSFLT_PEA_1_T19 |
| HSFLT_PEA_1_P19 | 537 | P365 | HSFLT_PEA_1_T25 |

These sequences are variants of the known protein Vascular endothelial growth factor receptor 1 precursor (SEQ ID NO:530; SwissProt accession identifier VGR1_HUMAN; known also according to the synonyms EC 2.7.1.112; VEGFR-1; Vascular permeability factor receptor; Tyrosine-protein kinase receptor FLT; Flt-1; Tyrosine-protein kinase FRT; Fms-like tyrosine kinase 1), referred to herein as the previously known protein.

Protein Vascular endothelial growth factor receptor 1 precursor is known or believed to have the following function(s): Receptor for VEGF, VEGFB and PGF. Has a tyrosine-protein kinase activity. The VEGF-kinase ligand/receptor signaling system plays a key role in vascular development and regulation of vascular permeability. Isoform SFlt1 may have an inhibitory role in angiogenesis. The sequence for protein Vascular endothelial growth factor receptor 1 precursor is given in SEQ ID NO: 530, as "Vascular endothelial growth factor receptor 1 precursor amino acid sequence". Known polymorphisms for this sequence are as shown in Table 97.

TABLE 97

Amino acid mutations for Known Protein

| SNP position(s) on amino acid sequence | Comment |
| --- | --- |
| 914 | Y → F: No loss of phosphorylation. |
| 1213 | Y → F: Loss of phosphorylation. |
| 1242 | Y → F: Loss of phosphorylation. |
| 1327 | Y → F: Loss of phosphorylation. |
| 1333 | Y → F: Loss of phosphorylation. |
| 779 | L → F |

Protein Vascular endothelial growth factor receptor 1 precursor localization is believed to be Type I membrane protein (Flt1) and soluble (SFlt1).

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein or of drugs directed to this protein are as follows: Endothelial growth factor agonist; Endothelial growth factor receptor kinase inhibitor; Angiogenesis modulator. A therapeutic role for a protein represented by the cluster has been predicted. The cluster was assigned this field because there was information in the drug database or the public databases (e.g., described herein above) that this protein, or part thereof, is used or can be used for a potential therapeutic and/or indications: Cardiovascular; Vulnerary; Anticancer; Symptomatic antidiabetic; peripheral vascular disease; ulcer; ischaemia.

The following GO Annotation(s) apply to the previously known protein. The following annotation(s) were found: angiogenesis; protein amino acid phosphorylation; transmembrane receptor protein tyrosine kinase signaling pathway; pregnancy; positive control of cell proliferation, which are annotation(s) related to Biological Process; receptor; vascular endothelial growth factor receptor; ATP binding; transferase, which are annotation(s) related to Molecular Function; and extracellular space; integral plasma membrane protein, which are annotation(s) related to Cellular Component.

The GO assignment relies on information from one or more of the SwissProt/TremB1 Protein knowledgebase, or Locuslink.

As noted above, cluster HSFLT features 8 transcript(s), which were listed in Table 94 above. These transcript(s) encode for protein(s) which are variant(s) of protein Vascular endothelial growth factor receptor 1 precursor. A description of each variant protein according to the present invention is now provided.

Variant protein HSFLT_PEA_1_P3 (SEQ ID NO:531) is encoded by transcript(s) HSFLT_PEA_1_T4. An alignment is given to the known protein (Vascular endothelial growth factor receptor 1 precursor; SEQ ID NO:530) is presented in FIG. 154. One or more alignments to one or more previously published protein sequences are given in FIGS. 155-160. A brief description of the relationship of the variant protein according to the present invention to each such aligned protein is as follows:

Comparison Report Between HSFLT_PEA_1_P3 and VGR1_HUMAN:

1. An isolated chimeric polypeptide HSFLT_PEA_1_P3, comprising a first amino acid sequence being at least 90% homologous to MVSYWDTGVLLCALLSCLLLTGSSSG-SKLKDPELSLKGTQHIMQAGQTLHLQ CRGEAAHK-WSLPEMVSKE-
SERLSITKSACGRNGKQFCSTLTLNTAQANHTGF YSCKYLAVPTSKKKETESAIYIFISDT-GRPFVEMYSEIPEIIHMTEGRELVIPCRV TSP-NITVTLKKFPLDTLIPDGKRIIWDSRKG-FIISNATYKEIGLLTCEATVNGHL YKTNYLTHRQTNTIIDVQISTPRPVKLL-RGHTLVLNCTATTPLNTRVQMTWSY PDEKNKRAS-VRRRIDQSNSHANIFYSVLTIDKMQNKD-KGLYTCRVRSGPSFKS VNTSVHIYDKAFITVKHRKQQV-LETVAGKRSYRLSMKVKAFPSPEVVWLKD GLPATEKSARYLTRGYSLIIKDV-TEEDAGNYTILLSIKQSNVFKNLTATLIVNV KPQIYEKAVSSFPDPALYPLGSR-QILTCTAYGIPQPTIKWFWHPCNHNHSEARC DFCSN-NEESFILDADSNMGNRIESITQRMAI-IEGKNKMASTLVVADSRISGIYIC IASNKVGTVGRNISFYIT corresponding to amino acids 1-553 of VGR1_HUMAN, which also corresponds to amino acids 1-553 of HSFLT_PEA_1_P3, and a second amino acid sequence being at least 70%, optionally at least 80%, preferably at least 85%, more preferably at least 90% and most preferably at least 95% homologous to a polypeptide having the sequence ELSNFECLHPCSQE corresponding to amino acids 554-567 of HSFLT_PEA_1_P3, wherein said first amino acid sequence and second amino acid sequence are contiguous and in a sequential order.

2. An isolated polypeptide for a tail of HSFLT_PEA_1_P3, comprising a polypeptide being at least 70%, optionally at least about 80%, preferably at least about 85%, more preferably at least about 90% and most preferably at least about 95% homologous to the sequence ELSNFECLHPC-SQE in HSFLT_PEA_1_P3.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSFLT_PEA_1_P3 also has the following non-silent SNPs (Single Nucleotide Polymorphisms) as listed in Table 98, (given according to their position(s) on the amino acid sequence, with the alternative amino acid(s) listed; the last column indicates whether the SNP is known or not; the presence of known SNPs in variant protein HSFLT_PEA_1_P3 sequence provides support for the deduced sequence of this variant protein according to the present invention).

TABLE 98

Amino acid mutations

| SNP position(s) on amino acid sequence | Alternative amino acid(s) | Previously known SNP? |
|---|---|---|
| 250 | L → P | No |
| 284 | Q → R | No |
| 343 | V → A | No |
| 394 | D → G | No |

The glycosylation sites of variant protein HSFLT_PEA_1_P3, as compared to the known protein Vascular endothelial growth factor receptor 1 precursor, are described in Table 99 (given according to their position(s) on the amino acid sequence in the first column; the second column indicates whether the glycosylation site is present in the variant protein; and the last column indicates whether the position is different on the variant protein).

TABLE 99

Glycosylation site(s)

| Position(s) on known amino acid sequence | Present in variant protein? | Position in variant protein? |
|---|---|---|
| 547 | yes | 547 |
| 474 | yes | 474 |
| 620 | no | |
| 666 | no | |
| 597 | no | |
| 100 | yes | 100 |
| 402 | yes | 402 |
| 323 | yes | 323 |
| 251 | yes | 251 |
| 164 | yes | 164 |
| 417 | yes | 417 |
| 625 | no | |
| 196 | yes | 196 |

The phosphorylation sites of variant protein HSFLT_PEA_1_P3, as compared to the known protein Vascular endothelial growth factor receptor 1 precursor, are described in Table 100 (given according to their position(s) on the amino acid sequence in the first column; the second column indicates whether the phosphorylation site is present in the variant protein; and the last column indicates whether the position is different on the variant protein).

TABLE 100

Phosphorylation site(s)

| Position(s) on known amino acid sequence | Present in variant protein? | Position in variant protein? |
|---|---|---|
| 1169 | no | |
| 1213 | no | |
| 1053 | no | |
| 1242 | no | |
| 1333 | no | |
| 1327 | no | |

The variant protein has the following domains, as determined by using InterPro. The domains are described in Table 101.

TABLE 101

InterPro domain(s)

| InterPro ID | Domain description | Analysis type | Position(s) on protein |
|---|---|---|---|
| IPR009134 | Vascular endothelial growth factor receptor, VEGFR | FPrintScan | 125-136, 184-194, 242-254, 390-407, 448-462, 89-107 |
| IPR009135 | Vascular endothelial growth factor receptor 1, VEGFR1 | FPrintScan | 130-155, 224-247, 26-41, 273-290, 350-370, 375-389, 79-93 |
| IPR007110 | Immunoglobulin-like | HMMPfam | 151-209, 245-313, 359-404, 447-537, 90-109 |
| IPR003598 | Immunoglobulin C-2 type | HMMSmart | 149-214, 243-318, 348-412 |
| IPR003599 | Immunoglobulin subtype | HMMSmart | 143-224, 237-329, 344-425, 38-129, 439-553 |
| IPR007110 | Immunoglobulin-like | ProfileScan | 230-327, 32-107, 349-404, 428-553 |

Variant protein HSFLT_PEA_1_P3 is encoded by the following transcript(s): HSFLT_PEA_1_T4. The coding portion of transcript HSFLT_PEA_1_T4 starts at position 315 and ends at position 2015. The transcript also has the following SNPs as listed in Table 102 (given according to their position on the nucleotide sequence, with the alternative nucleic acid listed; the last column indicates whether the SNP is known or not; the presence of known SNPs in variant protein HSFLT_PEA_1_P3 sequence provides support for the deduced sequence of this variant protein according to the present invention).

TABLE 102

Nucleic acid SNPs

| SNP position on nucleotide sequence | Alternative nucleic acid | Previously known SNP? |
|---|---|---|
| 719 | C → T | Yes |
| 823 | → C | No |
| 1063 | T → C | No |
| 1165 | A → G | No |
| 1325 | A → G | No |

TABLE 102-continued

Nucleic acid SNPs

| SNP position on nucleotide sequence | Alternative nucleic acid | Previously known SNP? |
|---|---|---|
| 1342 | T → C | No |
| 1495 | A → G | No |
| 1533 | C → T | No |
| 2083 | G → A | No |
| 2424 | A → | No |
| 2579 | C → T | Yes |
| 2605 | C → T | Yes |
| 2997 | T → | Yes |
| 3339 | G → A | Yes |
| 3524 | T → A | Yes |
| 3595 | A → G | No |
| 3615 | A → G | Yes |
| 3679 | A → | No |
| 4443 | A → G | Yes |
| 5614 | T → C | Yes |
| 5689 | T → A | Yes |
| 5716 | T → C | Yes |
| 5790 | T → G | Yes |
| 5814 | G → T | Yes |
| 6293 | T → G | Yes |

Variant protein HSFLT_PEA_1_P4 (SEQ ID NO:532) is encoded by transcript(s) HSFLT_PEA_1_T5. An alignment is given to the known protein (Vascular endothelial growth factor receptor 1 precursor; SEQ ID NO:530) in FIG. 155. One or more alignments to one or more previously published protein sequences are given in FIGS. 154, 156-160. A brief description of the relationship of the variant protein according to the present invention to each such aligned protein is as follows:

Comparison Report Between HSFLT_PEA_1_P4 and VGR1_HUMAN:

1. An isolated chimeric polypeptide HSFLT_PEA_1_P4, comprising a first amino acid sequence being at least 90% homologous to MVSYWDTGVLLCALLSCLLLTGSSSG-SKLKDPELSLKGTQHIMQAGQTLHLQ CRGEAAHK-WSLPEMVSKE-SERLSITKSACGRNGKQFCSTLTLNTAQANHTGF YSCKYLAVPTSKKKETESAIYIFISDT-GRPFVEMYSEIPEIIHMTEGRELVIPCRV TSP-NITVTLKKFPLDTLIPDGKRIIWDSRKG-FIISNATYKEIGLLTCEATVNGHL YKTNYLTHRQTNTIIDVQISTPRPVKLL-RGHTLVLNCTATTPLNTRVQMTWSY PDEKNKRAS-VRRRIDQSNSHANIFYSVLTIDKMQNKD-KGLYTCRVRSGPSFKS VNTSVHIYDKAFITVKHRKQQV-LETVAGKRSYRLSMKVKAFPSPEVVWLKD GLPATEKSARYLTRGYSLIIKDV-TEEDAGNYTILLSIKQSNVFKNLTATLIVNV KPQIYEKAVSSFPDPALYPLGSR-QILTCTAYGIPQPTIKWFWHPCNHNHSEARC DFCSN-NEESFILDADSNMGNRIESITQRMAIIEGKNK corresponding to amino acids 1-517 of VGR1_HUMAN, which also corresponds to amino acids 1-517 of HSFLT_PEA_1_P4, and a second amino acid sequence being at least 70%, optionally at least 80%, preferably at least 85%, more preferably at least 90% and most preferably at least 95% homologous to a polypeptide having the sequence LPPANSSFM-LPPTSFSSNYFHFLP corresponding to amino acids 518-541 of HSFLT_PEA_1_P4, wherein said first amino acid sequence and second amino acid sequence are contiguous and in a sequential order.

2. An isolated polypeptide for a tail of HSFLT_PEA_1_P4, comprising a polypeptide being at least 70%, optionally at least about 80%, preferably at least about 85%, more preferably at least about 90% and most preferably at least about 95% homologous to the sequence LPPANSSFM-LPPTSFSSNYFHFLP in HSFLT_PEA_1_P4.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSFLT_PEA_1_P4 also has the following non-silent SNPs (Single Nucleotide Polymorphisms) as listed in Table 103, (given according to their position(s) on the amino acid sequence, with the alternative amino acid(s) listed; the last column indicates whether the SNP is known or not; the presence of known SNPs in variant protein HSFLT_PEA_1_P4 sequence provides support for the deduced sequence of this variant protein according to the present invention).

TABLE 103

Amino acid mutations

| SNP position(s) on amino acid sequence | Alternative amino acid(s) | Previously known SNP? |
|---|---|---|
| 250 | L → P | No |
| 284 | Q → R | No |
| 343 | V → A | No |
| 394 | D → G | No |

The glycosylation sites of variant protein HSFLT_PEA_1_P4, as compared to the known protein Vascular endothelial growth factor receptor 1 precursor, are described in Table 104 (given according to their position(s) on the amino acid sequence in the first column; the second column indicates whether the glycosylation site is present in the variant protein; and the last column indicates whether the position is different on the variant protein).

TABLE 104

Glycosylation site(s)

| Position(s) on known amino acid sequence | Present in variant protein? | Position in variant protein? |
|---|---|---|
| 547 | no | |
| 474 | yes | 474 |
| 620 | no | |
| 666 | no | |
| 597 | no | |
| 100 | yes | 100 |
| 402 | yes | 402 |
| 323 | yes | 323 |
| 251 | yes | 251 |
| 164 | yes | 164 |
| 417 | yes | 417 |
| 625 | no | |
| 196 | yes | 196 |

The phosphorylation sites of variant protein HSFLT_PEA_1_P4, as compared to the known protein Vascular endothelial growth factor receptor 1 precursor, are described in Table 105 (given according to their position(s) on the amino acid sequence in the first column; the second column indicates whether the phosphorylation site is present in the variant protein; and the last column indicates whether the position is different on the variant protein).

TABLE 105

Phosphorylation site(s)

| Position(s) on known amino acid sequence | Present in variant protein? | Position in variant protein? |
|---|---|---|
| 1169 | no | |
| 1213 | no | |
| 1053 | no | |
| 1242 | no | |
| 1333 | no | |
| 1327 | no | |

The variant protein has the following domains, as determined by using InterPro. The domains are described in Table 106.

TABLE 106

InterPro domain(s)

| InterPro ID | Domain description | Analysis type | Position(s) on protein |
|---|---|---|---|
| IPR009134 | Vascular endothelial growth factor receptor, VEGFR | FPrintScan | 125-136, 184-194, 242-254, 390-407, 448-462, 89-107 |
| IPR009135 | Vascular endothelial growth factor receptor 1, VEGFR1 | FPrintScan | 130-155, 224-247, 26-41, 273-290, 350-370, 375-389, 79-93 |
| IPR007110 | Immunoglobulin-like | HMMPfam | 151-209, 245-313, 359-404, 447-467, 90-109 |
| IPR003598 | Immunoglobulin C-2 type | HMMSmart | 149-214, 243-318, 348-412 |
| IPR003599 | Immunoglobulin subtype | HMMSmart | 143-224, 237-329, 344-425, 38-129 |
| IPR007110 | Immunoglobulin-like | ProfileScan | 230-327, 32-107, 349-404, 428-467 |

Variant protein HSFLT_PEA_1_P4 is encoded by HSFLT_PEA_1_T5. The coding portion of transcript HSFLT_PEA_1_T5 starts at position 315 and ends at position 1937. The transcript also has the following SNPs as listed in Table 107 (given according to their position on the nucleotide sequence, with the alternative nucleic acid listed; the last column indicates whether the SNP is known or not; the presence of known SNPs in variant protein HSFLT_PEA_1_P4 sequence provides support for the deduced sequence of this variant protein according to the present invention).

TABLE 107

Nucleic acid SNPs

| SNP position on nucleotide sequence | Alternative nucleic acid | Previously known SNP? |
|---|---|---|
| 719 | C → T | Yes |
| 823 | → C | No |
| 1063 | T → C | No |
| 1165 | A → G | No |
| 1325 | A → G | No |
| 1342 | T → C | No |
| 1495 | A → G | No |
| 1533 | C → T | No |
| 2103 | G → A | No |

TABLE 107-continued

Nucleic acid SNPs

| SNP position on nucleotide sequence | Alternative nucleic acid | Previously known SNP? |
|---|---|---|
| 2444 | A → | No |
| 2599 | C → T | Yes |
| 2625 | C → T | Yes |
| 3017 | T → | Yes |
| 3359 | G → A | Yes |
| 3544 | T → A | Yes |
| 3615 | A → G | No |
| 3635 | A → G | Yes |
| 3699 | A → | No |
| 4463 | A → G | Yes |
| 5634 | T → C | Yes |
| 5709 | T → A | Yes |
| 5736 | T → C | Yes |
| 5810 | T → G | Yes |

TABLE 107-continued

Nucleic acid SNPs

| SNP position on nucleotide sequence | Alternative nucleic acid | Previously known SNP? |
|---|---|---|
| 5834 | G → T | Yes |
| 6313 | T → G | Yes |

Variant protein HSFLT_PEA_1_P10 (SEQ ID NO:533) according to the present invention is encoded by transcript(s) HSFLT_PEA_1_T13. An alignment is given to the known protein (Vascular endothelial growth factor receptor 1 precursor; SEQ ID NO:530) is presented in FIG. 155. A brief description of the relationship of the variant protein according to the present invention to each such aligned protein is as follows:

Comparison Report Between HSFLT_PEA_1_P10 and VGR1_HUMAN:

1. An isolated chimeric polypeptide HSFLT_PEA_1_P10, comprising a first amino acid sequence being at least 90% homologous to MVSYWDTGVLLCALLSCLLLTGSSSG-SKLKDPELSLKGTQHIMQAGQTLHLQ CRGEAAHK-WSLPEMVSKESERLSITKSACGRNGKQFCSTLT-LNTAQANHTGF YSCKYLAVPTSKKKETESAIYIFIS- DTGRPFVEMYSEIPEIIHMTEGRELVIPCRV TSP-NITVTLKKFPLDTLIPDGKRIIWDSRKG-FIISNATYKEIGLLTCEATVNGHL YKTNYLTHRQTNTIIDVQISTPRPVKLL-RGHTLVLNCTATTPLNTRVQMTWSY PDEKNKRAS-VRRRIDQSNSHANIFYSVLTIDKMQNKD-KGLYTCRVRSGPSFKS VNTSVHIYDKAFITVKHRKQQV-LETVAGKRSYRLSMKVKAFPSPEVVWLKD GLPATEKSARYLTRGYSLIIKDV-TEEDAGNYTILLSIKQSNVFKNLTATLIVNV KPQIYEKAVSSFPDPALYPLGSR-QILTCTAYGIPQPTIKWFWHPCNHNHSEARC DFCSN-NEESFILDADSNMGNRIESITQRMAI-IEGKNKMASTLVVADSRISGIYIC IASNKVGTVGRNISFYITDVPNGFHVN-LEKMPTEGEDLKLSCTVNKFLYRDVT WILLRTVN-NRTMHYSISKQKMAITKEHSITLNLTIM-NVSLQDSGTYACRARNV YTGEEILQKKEITIRDQEAPYLLRNLS-DHTVAISSSTTLDCHANGVPEPQITWF KNNHKIQQEP corresponding to amino acids 1-705 of VGR1_HUMAN, which also corresponds to amino acids 1-705 of HSFLT_PEA_1_P10, and a second amino acid sequence being at least 70%, optionally at least 80%, preferably at least 85%, more preferably at least 90% and most preferably at least 95% homologous to a polypeptide having the sequence ELYTSTSPSSSSSSPLSSSSSSSSSSSS corresponding to amino acids 706-733 of HSFLT_PEA_1_P10, wherein said first amino acid sequence and second amino acid sequence are contiguous and in a sequential order.

2. An isolated polypeptide for a tail of HSFLT_PEA_1_P10, comprising a polypeptide being at least 70%, optionally at least about 80%, preferably at least about 85%, more preferably at least about 90% and most preferably at least about 95% homologous to the sequence ELYTSTSPSSSSSS-PLSSSSSSSSSSSS in HSFLT_PEA_1_P10.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSFLT_PEA_1_P10 also has the following non-silent SNPs (Single Nucleotide Polymorphisms) as listed in Table 108, (given according to their position(s) on the amino acid sequence, with the alternative amino acid(s) listed; the last column indicates whether the SNP is known or not; the presence of known SNPs in variant protein HSFLT_PEA_1_P10 sequence provides support for the deduced sequence of this variant protein according to the present invention).

TABLE 108

Amino acid mutations

| SNP position(s) on amino acid sequence | Alternative amino acid(s) | Previously known SNP? |
|---|---|---|
| 250 | L → P | No |
| 284 | Q → R | No |
| 343 | V → A | No |
| 394 | D → G | No |

The glycosylation sites of variant protein HSFLT_PEA_1_P10, as compared to the known protein Vascular endothelial growth factor receptor 1 precursor, are described in Table 109 (given according to their position(s) on the amino acid sequence in the first column; the second column indicates whether the glycosylation site is present in the variant protein; and the last column indicates whether the position is different on the variant protein).

TABLE 109

Glycosylation site(s)

| Position(s) on known amino acid sequence | Present in variant protein? | Position in variant protein? |
|---|---|---|
| 547 | yes | 547 |
| 474 | yes | 474 |
| 620 | yes | 620 |
| 666 | yes | 666 |
| 597 | yes | 597 |
| 100 | yes | 100 |
| 402 | yes | 402 |
| 323 | yes | 323 |
| 251 | yes | 251 |
| 164 | yes | 164 |
| 417 | yes | 417 |
| 625 | yes | 625 |
| 196 | yes | 196 |

The phosphorylation sites of variant protein HSFLT_PEA_1_P10, as compared to the known protein Vascular endothelial growth factor receptor 1 precursor, are described in Table 110 (given according to their position(s) on the amino acid sequence in the first column; the second column indicates whether the phosphorylation site is present in the variant protein; and the last column indicates whether the position is different on the variant protein).

TABLE 110

Phosphorylation site(s)

| Position(s) on known amino acid sequence | Present in variant protein? | Position in variant protein? |
|---|---|---|
| 1169 | no | |
| 1213 | no | |
| 1053 | no | |
| 1242 | no | |
| 1333 | no | |
| 1327 | no | |

The variant protein has the following domains, as determined by using InterPro. The domains are described in Table 111.

TABLE 111

InterPro domain(s)

| InterPro ID | Domain description | Analysis type | Position(s) on protein |
|---|---|---|---|
| IPR003598 | Immunoglobulin C-2 type | HMMSmart | 149-214, 243-318, 348-412, 568-643, 673-732 |
| IPR003599 | Immunoglobulin subtype | HMMSmart | 143-224, 237-329, 344-425, 38-129, 439-553, 562-658 |
| IPR007110 | Immunoglobulin-like | ProfileScan | 230-327, 32-107, 349-404, 428-553, 556-654, 661-733 |

TABLE 111-continued

InterPro domain(s)

| InterPro ID | Domain description | Analysis type | Position(s) on protein |
|---|---|---|---|
| IPR009134 | Vascular endothelial growth factor receptor, VEGFR | FPrintScan | 125-136, 184-194, 242-254, 390-407, 448-462, 89-107 |
| IPR009135 | Vascular endothelial growth factor receptor 1, VEGFR1 | FPrintScan | 130-155, 224-247, 26-41, 273-290, 350-370, 375-389, 79-93 |
| IPR007110 | Immunoglobulin-like | HMMPfam | 151-209, 245-313, 359-404, 447-537, 570-638, 675-733, 90-109 |
| IPR003596 | Immunoglobulin V-type | HMMSmart | 247-313, 572-638 |

Variant protein HSFLT_PEA_1_P10 is encoded by HSFLT_PEA_1_T13. The coding portion of transcript HSFLT_PEA_1_T13 starts at position 315 and ends at position 2513. The transcript also has the following SNPs as listed in Table 112 (given according to their position on the nucleotide sequence, with the alternative nucleic acid listed; the last column indicates whether the SNP is known or not; the presence of known SNPs in variant protein HSFLT_PEA_1_P10 sequence provides support for the deduced sequence of this variant protein according to the present invention).

TABLE 112

Nucleic acid SNPs

| SNP position on nucleotide sequence | Alternative nucleic acid | Previously known SNP? |
|---|---|---|
| 719 | C → T | Yes |
| 823 | → C | No |
| 1063 | T → C | No |
| 1165 | A → G | No |
| 1325 | A → G | No |
| 1342 | T → C | No |
| 1495 | A → G | No |
| 1533 | C → T | No |
| 2018 | G → A | No |
| 2375 | C → T | Yes |
| 2656 | G → | No |
| 2781 | G → A | Yes |
| 3301 | G → T | Yes |

Variant protein HSFLT_PEA_1_P12 according to the present invention is encoded by transcript(s) HSFLT_PEA_1_T15. An alignment is given to the known protein (Vascular endothelial growth factor receptor 1 precursor) in FIG. 157. A brief description of the relationship of the variant protein according to the present invention to each such aligned protein is as follows:

Comparison Report Between HSFLT_PEA_1_P12 and VGR1_HUMAN:

1. An isolated chimeric polypeptide HSFLT_PEA_1_P12, comprising a first amino acid sequence being at least 90% homologous to MVSYWDTGVLLCALLSCLLLTGSSSG-SKLKDPELSLKGTQHIMQAGQTLHLQ CRGEAAHK-WSLPEMVSKE-SERLSITKSACGRNGKQFCSTLTLNTAQANHTGF YSCKYLAVPTSKKKETESAIYIFISDT-GRPFVEMYSEIPEIIHMTEGRELVIPCRV TSP-NITVTLKKFPLDTLIPDGKRIIWDSRKG-FIISNATYKEIGLLTCEATVNGHL YKTNYLTHRQTNTIIDVQISTPRPVKLL-RGHTLVLNCTATTPLNTRVQMTWSY PDEKNKRAS-VRRRIDQSNSHANIFYSVLTIDKMQNKD-KGLYTCRVRSGPSFKS VNTSVHIYDKAFITVKHRKQQV-LETVAGKRSYRLSMKVKAFPSPEVVWLKD GLPATEKSARYLTRGYSLIIKDV-TEEDAGNYTILLSIKQSNVFKNLTATLIVNV KPQIYEKAVSSFPDPALYPLGSR-QILTCTAYGIPQPTIKWFWHPCNHNHSEARC DFCSN-NEESFILDADSNMGNRIESITQRMAI-IEGKNKMASTLVVADSRISGIYIC IASNKVGTVGRNISFYITDVPNGFHVN-LEKMPTEGEDLKLSCTVNKFLYRDVT WILLRTVN-NRTMHYSISKQKMAITKEHSITLNLTIM-NVSLQDSGTYACRARNV YTGEEILQKKEITIRDQEAPYLLRNLS-DHTVAISSSTTLDCHANGVPEPQITWF KNNH-KIQQEPG corresponding to amino acids 1-706 of VGR1_HUMAN, which also corresponds to amino acids 1-706 of HSFLT_PEA_1_P12, and a second amino acid sequence being at least 70%, optionally at least 80%, preferably at least 85%, more preferably at least 90% and most preferably at least 95% homologous to a polypeptide having the sequence SANTAVNKKTEI corresponding to amino acids 707-718 of HSFLT_PEA_1_P12, wherein said first amino acid sequence and second amino acid sequence are contiguous and in a sequential order.

2. An isolated polypeptide for a tail of HSFLT_PEA_1_P12, comprising a polypeptide being at least 70%, optionally at least about 80%, preferably at least about 85%, more preferably at least about 90% and most preferably at least about 95% homologous to the sequence SANTAVNKKTEI in HSFLT_PEA_1_P12.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

The glycosylation sites of variant protein HSFLT_PEA_1_P12, as compared to the known protein Vascular endothelial growth factor receptor 1 precursor, are described in Table 113 (given according to their position(s) on the amino acid sequence in the first column; the second column indicates whether the glycosylation site is present in the variant protein; and the last column indicates whether the position is different on the variant protein).

TABLE 113

Glycosylation site(s)

| Position(s) on known amino acid sequence | Present in variant protein? | Position in variant protein? |
|---|---|---|
| 547 | yes | 547 |
| 474 | yes | 474 |
| 620 | yes | 620 |
| 666 | yes | 666 |
| 597 | yes | 597 |
| 100 | yes | 100 |
| 402 | yes | 402 |
| 323 | yes | 323 |
| 251 | yes | 251 |
| 164 | yes | 164 |

TABLE 113-continued

Glycosylation site(s)

| Position(s) on known amino acid sequence | Present in variant protein? | Position in variant protein? |
|---|---|---|
| 417 | yes | 417 |
| 625 | yes | 625 |
| 196 | yes | 196 |

The phosphorylation sites of variant protein HSFLT_PEA_1_P12, as compared to the known protein Vascular endothelial growth factor receptor 1 precursor, are described in Table 114 (given according to their position(s) on the amino acid sequence in the first column; the second column indicates whether the phosphorylation site is present in the variant protein; and the last column indicates whether the position is different on the variant protein).

TABLE 114

Phosphorylation site(s)

| Position(s) on known amino acid sequence | Present in variant protein? | Position in variant protein? |
|---|---|---|
| 1169 | no | |
| 1213 | no | |
| 1053 | no | |
| 1242 | no | |
| 1333 | no | |
| 1327 | no | |

The variant protein has the following domains, as determined by using InterPro. The domains are described in Table 115.

TABLE 115

InterPro domain(s)

| InterPro ID | Domain description | Analysis type | Position(s) on protein |
|---|---|---|---|
| IPR009134 | Vascular endothelial growth factor receptor, VEGFR | FPrintScan | 125-136, 184-194, 242-254, 390-407, 448-462, 89-107 |
| IPR009135 | Vascular endothelial growth factor receptor 1, VEGFR1 | FPrintScan | 130-155, 224-247, 26-41, 273-290, 350-370, 375-389, 79-93 |
| IPR007110 | Immunoglobulin-like | HMMPfam | 151-209, 245-313, 359-404, 447-537, 570-638, 675-702, 90-109 |
| IPR003596 | Immunoglobulin V-type | HMMSmart | 247-313, 572-638 |
| IPR003598 | Immunoglobulin C-2 type | HMMSmart | 149-214, 243-318, 348-412, 568-643, 673-716 |
| IPR003599 | Immunoglobulin subtype | HMMSmart | 143-224, 237-329, 344-425, 38-129, 439-553, 562-658 |
| IPR007110 | Immunoglobulin-like | ProfileScan | 230-327, 32-107, 349-404, 428-553, 556-654, 661-718 |

Variant protein HSFLT_PEA_1_P12 is encoded by the following transcript(s): HSFLT_PEA_1_T15. The coding portion of transcript HSFLT_PEA_1_T15 starts at position 315 and ends at position 2468. The transcript also has the following SNPs as listed in Table 116 (given according to their position on the nucleotide sequence, with the alternative nucleic acid listed; the last column indicates whether the SNP is known or not; the presence of known SNPs in variant protein HSFLT_PEA_1_P12 sequence provides support for the deduced sequence of this variant protein according to the present invention).

TABLE 116

Nucleic acid SNPs

| SNP position on nucleotide sequence | Alternative nucleic acid | Previously known SNP? |
|---|---|---|
| 719 | C → T | Yes |
| 823 | → C | No |
| 1063 | T → C | No |
| 1165 | A → G | No |
| 1325 | A → G | No |
| 1342 | T → C | No |
| 1495 | A → G | No |
| 1533 | C → T | No |
| 2018 | G → A | No |
| 2375 | C → T | Yes |

Variant protein HSFLT_PEA_1_P13 according to the present invention is encoded by transcript(s) HSFLT_PEA_1_T16. An alignment is given to the known protein (Vascular endothelial growth factor receptor 1 precursor) in FIG. 158. A brief description of the relationship of the variant protein according to the present invention to each such aligned protein is as follows:

Comparison Report Between HSFLT_PEA_1_P13 and VGR1_HUMAN:

1. An isolated chimeric polypeptide HSFLT_PEA_1_P13, comprising a first amino acid sequence being at least 90% homologous to MVSYWDTGVLLCALLSCLLLTGSSSG-SKLKDPELSLKGTQHIMQAGQTLHLQ CRGEAAHK-WSLPEMVSKE-SERLSITKSACGRNGKQFCSTLTLNTAQANHTGF YSCKYLAVPTSKKKETESAIYIFISDT-GRPFVEMYSEIPEIIHMTEGRELVIPCRV TSP-NITVTLKKFPLDTLIPDGKRIIWDSRKG-FIISNATYKEIGLLTCEATVNGHL YKTNYLTHRQTNTIIDVQISTPRPVKLL-RGHTLVLNCTATTPLNTRVQMTWSY PDEKNKRAS-VRRRIDQSNSHANIFYSVLTIDKMQNKD-KGLYTCRVRSGPSFKS VNTSVHIYDKAFITVKHRKQQV-LETVAGKRSYRLSMKVKAFPSPEVVWLKD GLPATEKSARYLTRGYSLIIKDV-TEEDAGNYTILLSIKQSNVFKNLTATLIVNV KPQIYEKAVSSFPDPALYPLGSR-QILTCTAYGIPQPTIKWFWHPCNHNHSEARC DFCSN- NEESFILDADSNMGNRIESITQRMAI-IEGKNKMASTLVVADSRISGIYIC IASNKVGTVGRNISFYITDVPNGFHVN-LEKMPTEGEDLKLSCTVNKFLYRDVT WILLRTVN-NRTMHYSISKQKMAITKEHSITLNLTIM-NVSLQDSGTYACRARNV YTGEEILQKKEITIRDQEAPYLLRNLS-DHTVAISSSTTLDCHANGVPEPQITWF KNNH-KIQQEPG corresponding to amino acids 1-706 of VGR1_HUMAN, which also corresponds to amino acids 1-706 of HSFLT_PEA_1_P13, and a second amino acid sequence being at least 70%, optionally at least 80%, preferably at least 85%, more preferably at least 90% and most preferably at least 95% homologous to a polypeptide having the sequence KRLFFLPFIISHLSSAPLSLNSPVTCFQYV corresponding to amino acids 707-736 of HSFLT_PEA_1_P13, wherein said first amino acid sequence and second amino acid sequence are contiguous and in a sequential order.

2. An isolated polypeptide for a tail of HSFLT_PEA_1_P13, comprising a polypeptide being at least 70%, optionally at least about 80%, preferably at least about 85%, more preferably at least about 90% and most preferably at least about 95% homologous to the sequence KRLFFLPFI-ISHLSSAPLSLNSPVTCFQYV in HSFLT_PEA_ 1_P13.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSFLT_PEA_1_P13 also has the following non-silent SNPs (Single Nucleotide Polymorphisms) as listed in Table 117, (given according to their position(s) on the amino acid sequence, with the alternative amino acid(s) listed; the last column indicates whether the SNP is known or not; the presence of known SNPs in variant protein HSFLT_PEA_1_P13 sequence provides support for the deduced sequence of this variant protein according to the present invention).

TABLE 117

Amino acid mutations

| SNP position(s) on amino acid sequence | Alternative amino acid(s) | Previously known SNP? |
|---|---|---|
| 250 | L → P | No |
| 284 | Q → R | No |
| 343 | V → A | No |
| 394 | D → G | No |
| 728 | S → I | Yes |

The glycosylation sites of variant protein HSFLT_PEA_1_P13, as compared to the known protein Vascular endothelial growth factor receptor 1 precursor, are described in Table 1118 (given according to their position(s) on the amino acid sequence in the first column; the second column indicates whether the glycosylation site is present in the variant protein; and the last column indicates whether the position is different on the variant protein).

TABLE 118

Glycosylation site(s)

| Position(s) on known amino acid sequence | Present in variant protein? | Position in variant protein? |
|---|---|---|
| 547 | yes | 547 |
| 474 | yes | 474 |
| 620 | yes | 620 |
| 666 | yes | 666 |
| 597 | yes | 597 |
| 100 | yes | 100 |
| 402 | yes | 402 |
| 323 | yes | 323 |
| 251 | yes | 251 |
| 164 | yes | 164 |
| 417 | yes | 417 |
| 625 | yes | 625 |
| 196 | yes | 196 |

The phosphorylation sites of variant protein HSFLT_PEA_1_P13, as compared to the known protein Vascular endothelial growth factor receptor 1 precursor, are described in Table 119 (given according to their position(s) on the amino acid sequence in the first column; the second column indicates whether the phosphorylation site is present in the variant protein; and the last column indicates whether the position is different on the variant protein).

TABLE 119

Phosphorylation site(s)

| Position(s) on known amino acid sequence | Present in variant protein? | Position in variant protein? |
|---|---|---|
| 1169 | no | |
| 1213 | no | |
| 1053 | no | |
| 1242 | no | |
| 1333 | no | |
| 1327 | no | |

The variant protein has the following domains, as determined by using InterPro. The domains are described in Table 120.

TABLE 120

InterPro domain(s)

| InterPro ID | Domain description | Analysis type | Position(s) on protein |
|---|---|---|---|
| IPR009134 | Vascular endothelial growth factor receptor, VEGFR | FPrintScan | 125-136, 184-194, 242-254, 390-407, 448-462, 89-107 |

TABLE 120-continued

| | InterPro domain(s) | | |
|---|---|---|---|
| InterPro ID | Domain description | Analysis type | Position(s) on protein |
| IPR009135 | Vascular endothelial growth factor receptor 1, VEGFR1 | FPrintScan | 130-155, 224-247, 26-41, 273-290, 350-370, 375-389, 79-93 |
| IPR007110 | Immunoglobulin-like | HMMPfam | 151-209, 245-313, 359-404, 447-537, 570-638, 675-734, 90-109 |
| IPR003596 | Immunoglobulin V-type | HMMSmart | 247-313, 572-638 |
| IPR003598 | Immunoglobulin C-2 type | HMMSmart | 149-214, 243-318, 348-412, 568-643, 673-725 |
| IPR003599 | Immunoglobulin subtype | HMMSmart | 143-224, 237-329, 344-425, 38-129, 439-553, 562-658 |
| IPR007110 | Immunoglobulin-like | ProfileScan | 230-327, 32-107, 349-404, 428-553, 556-654, 661-732 |

Variant protein HSFLT_PEA_1_P13 is encoded by the following transcript(s): HSFLT_PEA_1_T16. The coding portion of transcript HSFLT_PEA_1_T16 starts at position 315 and ends at position 2522. The transcript also has the following SNPs as listed in Table 121 (given according to their position on the nucleotide sequence, with the alternative nucleic acid listed; the last column indicates whether the SNP is known or not; the presence of known SNPs in variant protein HSFLT_PEA_1_P13 sequence provides support for the deduced sequence of this variant protein according to the present invention).

TABLE 121

| Nucleic acid SNPs | | |
|---|---|---|
| SNP position on nucleotide sequence | Alternative nucleic acid | Previously known SNP? |
| 719 | C → T | Yes |
| 823 | → C | No |
| 1063 | T → C | No |
| 1165 | A → G | No |
| 1325 | A → G | No |
| 1342 | T → C | No |
| 1495 | A → G | No |
| 1533 | C → T | No |
| 2018 | G → A | No |
| 2375 | C → T | Yes |
| 2497 | G → T | Yes |
| 2636 | G → A | Yes |

Variant protein HSFLT_PEA_1_P14 according to the present invention is encoded by transcript(s) HSFLT_PEA_1_T19. An alignment is given to the known protein (Vascular endothelial growth factor receptor 1 precursor) in FIG. 159. A brief description of the relationship of the variant protein according to the present invention to each such aligned protein is as follows:

Comparison Report Between HSFLT_PEA_1_P14 and VGR1_HUMAN:

1. An isolated chimeric polypeptide HSFLT_PEA_1_P14, comprising a first amino acid sequence being at least 90% homologous to MVSYWDTGVLLCALLSCLLLTGSSSG-SKLKDPELSLKGTQHIMQAGQTLHLQ CRGEAAHK-WSLPEMVSKE-SERLSITKSACGRNGKQFCSTLTLNTAQANHTGF YSCKYLAVPTSKKKETESAIYIFISDT-GRPFVEMYSEIPEIIHMTEGRELVIPCRV TSP-NITVTLKKFPLDTLIPDGKRIIWDSRKG-FIISNATYKEIGLLTCEATVNGHL YKTNYLTHRQTNTIIDVQISTPRPVKLL-RGHTLVLNCTATTPLNTRVQMTWSY PDEKNKRAS-VRRRIDQSNSHANIFYSVLTIDKMQNKD-KGLYTCRVRSGPSFKS VNTSVHIYDKAFITVKHRKQQV-LETVAGKRSYRLSMKVKAFPSPEVVWLKD GLPATEKSARYLTRGYSLIIKDV-TEEDAGNYTILLSIKQSNVFKNLTATLIVNV KPQIYEKAVSSFPDPALYPLGSR-QILTCTAYGIPQPTIKWFWHPCNHNHSEARC DFCSN-NEESFILDADSNMGNRIESITQRMAIIEGKNK corresponding to amino acids 1-517 of VGR1_HUMAN, which also corresponds to amino acids 1-517 of HSFLT_PEA_1_P14, and a second amino acid sequence being at least 70%, optionally at least 80%, preferably at least 85%, more preferably at least 90% and most preferably at least 95% homologous to a polypeptide having the sequence YLDIRTEEQIF-SFIQKTQTLKLTVSCKAAF corresponding to amino acids 518-547 of HSFLT_PEA_1_P14, wherein said first amino acid sequence and second amino acid sequence are contiguous and in a sequential order.

2. An isolated polypeptide for a tail of HSFLT_PEA_1_P14, comprising a polypeptide being at least 70%, optionally at least about 80%, preferably at least about 85%, more preferably at least about 90% and most preferably at least about 95% homologous to the sequence YLDIRTEEQIFS-FIQKTQTLKLTVSCKAAF in HSFLT_PEA_1_P14.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSFLT_PEA_1_P14 also has the following non-silent SNPs (Single Nucleotide Polymorphisms) as listed in Table 122, (given according to their position(s) on the amino acid sequence, with the alternative amino acid(s) listed; the last column indicates whether the SNP is known or not; the presence of known SNPs in variant protein HSFLT_PEA_1_P14 sequence provides support for the deduced sequence of this variant protein according to the present invention).

TABLE 122

Amino acid mutations

| SNP position(s) on amino acid sequence | Alternative amino acid(s) | Previously known SNP? |
|---|---|---|
| 250 | L → P | No |
| 284 | Q → R | No |
| 343 | V → A | No |
| 394 | D → G | No |

The glycosylation sites of variant protein HSFLT_PEA_1_P14, as compared to the known protein Vascular endothelial growth factor receptor 1 precursor, are described in Table 123 (given according to their position(s) on the amino acid sequence in the first column; the second column indicates whether the glycosylation site is present in the variant protein; and the last column indicates whether the position is different on the variant protein).

TABLE 123

Glycosylation site(s)

| Position(s) on known amino acid sequence | Present in variant protein? | Position in variant protein? |
|---|---|---|
| 547 | no | |
| 474 | yes | 474 |
| 620 | no | |
| 666 | no | |
| 597 | no | |
| 100 | yes | 100 |
| 402 | yes | 402 |
| 323 | yes | 323 |
| 251 | yes | 251 |
| 164 | yes | 164 |
| 417 | yes | 417 |
| 625 | no | |
| 196 | yes | 196 |

The phosphorylation sites of variant protein HSFLT_PEA_1_P14, as compared to the known protein Vascular endothelial growth factor receptor 1 precursor, are described in Table 124 (given according to their position(s) on the amino acid sequence in the first column; the second column indicates whether the phosphorylation site is present in the variant protein; and the last column indicates whether the position is different on the variant protein).

TABLE 124

Phosphorylation site(s)

| Position(s) on known amino acid sequence | Present in variant protein? | Position in variant protein? |
|---|---|---|
| 1169 | no | |
| 1213 | no | |
| 1053 | no | |
| 1242 | no | |
| 1333 | no | |
| 1327 | no | |

The variant protein has the following domains, as determined by using InterPro. The domains are described in Table 125.

TABLE 125

InterPro domain(s)

| InterPro ID | Domain description | Analysis type | Position(s) on protein |
|---|---|---|---|
| IPR003599 | Immunoglobulin subtype | HMMSmart | 143-224, 237-329, 344-425, 38-129 |
| IPR007110 | Immunoglobulin-like | ProfileScan | 230-327, 32-107, 349-404, 428-467 |
| IPR003598 | Immunoglobulin C-2 type | HMMSmart | 348-412 |
| IPR009134 | Vascular endothelial growth factor receptor, VEGFR | FPrintScan | 125-136, 184-194, 242-254, 390-407, 448-462, 89-107 |
| IPR009135 | Vascular endothelial growth factor receptor 1, VEGFR1 | FPrintScan | 130-155, 224-247, 26-41, 273-290, 350-370, 375-389, 79-93 |
| IPR007110 | Immunoglobulin-like | HMMPfam | 151-209, 245-313, 359-404, 447-467, 90-109 |
| IPR003598 | Immunoglobulin C-2 type | HMMSmart | 149-214, 243-318 |

Variant protein HSFLT_PEA_1_P14 is encoded by the following transcript(s): HSFLT_PEA_1_T19. The coding portion of transcript HSFLT_PEA_1_T19 starts at position 315 and ends at position 1955. The transcript also has the following SNPs as listed in Table 126 (given according to their position on the nucleotide sequence, with the alternative nucleic acid listed; the last column indicates whether the SNP is known or not; the presence of known SNPs in variant protein HSFLT_PEA_1_P14 sequence provides support for the deduced sequence of this variant protein according to the present invention).

TABLE 126

Nucleic acid SNPs

| SNP position on nucleotide sequence | Alternative nucleic acid | Previously known SNP? |
|---|---|---|
| 719 | C → T | Yes |
| 823 | → C | No |
| 1063 | T → C | No |
| 1165 | A → G | No |
| 1325 | A → G | No |
| 1342 | T → C | No |
| 1495 | A → G | No |
| 1533 | C → T | No |
| 2465 | A → G | Yes |

Variant protein HSFLT_PEA_1_P19 according to the present invention is encoded by transcript(s) HSFLT_PEA_1_T25. An alignment is given to the known protein (Vascular endothelial growth factor receptor 1 precursor) in FIG. 160. A brief description of the relationship of the variant protein according to the present invention to each such aligned protein is as follows:

Comparison Report Between HSFLT_PEA_1_P19 and VGR1_HUMAN:

1. An isolated chimeric polypeptide HSFLT_PEA_1_P19, comprising a first amino acid sequence being at least 90% homologous to MVSYWDTGVLLCALLSCLLLTGSSSG-SKLKDPELSLKGTQHIMQAGQTLHLQ CRGEAAHK-WSLPEMVSKE-SERLSITKSACGRNGKQFCSTLTLNTAQANHTGF YSCKYLAVPTSKKKETESAIYIFISDT-GRPFVEMYSEIPEIIHMTEGRELVIPCRV TSP-NITVTLKKFPLDTLIPDGKRIIWDSRKG-FIISNATYKEIGLLTCEATVNGHL YKTNYLTHRQTNTIIDVQISTPRPVKLL-RGHTLVLNCTATTPLNTRVQMTWSY PDEKNKRAS-VRRRIDQSNSHANIFYSVLTIDKMQNKD-KGLYTCRVRSGPSFKS VNTSVHIY corresponding to amino acids 1-329 of VGR1_HUMAN, which also corresponds to amino acids 1-329 of HSFLT_PEA_1_P19, and a second amino acid sequence being at least 70%, optionally at least 80%, preferably at least 85%, more preferably at least 90% and most preferably at least 95% homologous to a polypeptide having the sequence GKHSSALPTHAMLSN-HCRCLCSLNKSVFCWPRVTLS corresponding to amino acids 330-365 of HSFLT_PEA_1_P19, wherein said first amino acid sequence and second amino acid sequence are contiguous and in a sequential order.

2. An isolated polypeptide for a tail of HSFLT_PEA_1_P19, comprising a polypeptide being at least 70%, optionally at least about 80%, preferably at least about 85%, more preferably at least about 90% and most preferably at least about 95% homologous to the sequence GKHSSAL-PTHAMLSNHCRCLCSLNKSVFCWPRVTLS in HSFLT_PEA_1_P19. The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSFLT_PEA_1_P19 also has the following non-silent SNPs (Single Nucleotide Polymorphisms) as listed in Table 127, (given according to their position(s) on the amino acid sequence, with the alternative amino acid(s) listed; the last column indicates whether the SNP is known or not; the presence of known SNPs in variant protein HSFLT_PEA_1_P19 sequence provides support for the deduced sequence of this variant protein according to the present invention).

TABLE 127

Amino acid mutations

| SNP position(s) on amino acid sequence | Alternative amino acid(s) | Previously known SNP? |
|---|---|---|
| 250 | L → P | No |
| 284 | Q → R | No |

The glycosylation sites of variant protein HSFLT_PEA_1_P19, as compared to the known protein Vascular endothelial growth factor receptor 1 precursor, are described in Table 128 (given according to their position(s) on the amino acid sequence in the first column; the second column indicates whether the glycosylation site is present in the variant protein; and the last column indicates whether the position is different on the variant protein).

TABLE 128

Glycosylation site(s)

| Position(s) on known amino acid sequence | Present in variant protein? | Position in variant protein? |
|---|---|---|
| 547 | no | |
| 474 | no | |
| 620 | no | |
| 666 | no | |
| 597 | no | |
| 100 | yes | 100 |
| 402 | no | |
| 323 | yes | 323 |
| 251 | yes | 251 |
| 164 | yes | 164 |
| 417 | no | |
| 625 | no | |
| 196 | yes | 196 |

The phosphorylation sites of variant protein HSFLT_PEA_1_P19, as compared to the known protein Vascular endothelial growth factor receptor 1 precursor, are described in Table 129 (given according to their position(s) on the amino acid sequence in the first column; the second column indicates whether the phosphorylation site is present in the variant protein; and the last column indicates whether the position is different on the variant protein).

TABLE 129

Phosphorylation site(s)

| Position(s) on known amino acid sequence | Present in variant protein? | Position in variant protein? |
|---|---|---|
| 1169 | no | |
| 1213 | no | |
| 1053 | no | |
| 1242 | no | |
| 1333 | no | |
| 1327 | no | |

The variant protein has the following domains, as determined by using InterPro. The domains are described in Table 130.

TABLE 130

InterPro domain(s)

| InterPro ID | Domain description | Analysis type | Position(s) on protein |
|---|---|---|---|
| IPR009134 | Vascular endothelial growth factor receptor, VEGFR | FPrintScan | 125-136, 184-194, 242-254, 89-107 |
| IPR009135 | Vascular endothelial growth factor receptor 1, VEGFR1 | FPrintScan | 130-155, 224-247, 26-41, 273-290, 79-93 |
| IPR003598 | Immunoglobulin C-2 type | HMMSmart | 149-214, 243-318 |
| IPR003599 | Immunoglobulin subtype | HMMSmart | 143-224, 237-329, 38-129 |
| IPR007110 | Immunoglobulin-like | ProfileScan | 230-327, 32-107 |

Variant protein HSFLT_PEA_1_P19 is encoded by the following transcript(s): HSFLT_PEA_1_T25. The coding portion of transcript HSFLT_PEA_1_T25 starts at position 315 and ends at position 1409. The transcript also has the following SNPs as listed in Table 131 (given according to their position on the nucleotide sequence, with the alternative nucleic acid listed; the last column indicates whether the SNP is known or not; the presence of known SNPs in variant protein HSFLT_PEA_1_P19 sequence provides support for the deduced sequence of this variant protein according to the present invention).

TABLE 131

Nucleic acid SNPs

| SNP position on nucleotide sequence | Alternative nucleic acid | Previously known SNP? |
|---|---|---|
| 719 | C → T | Yes |
| 823 | → C | No |
| 1063 | T → C | No |
| 1165 | A → G | No |

Figure 36:
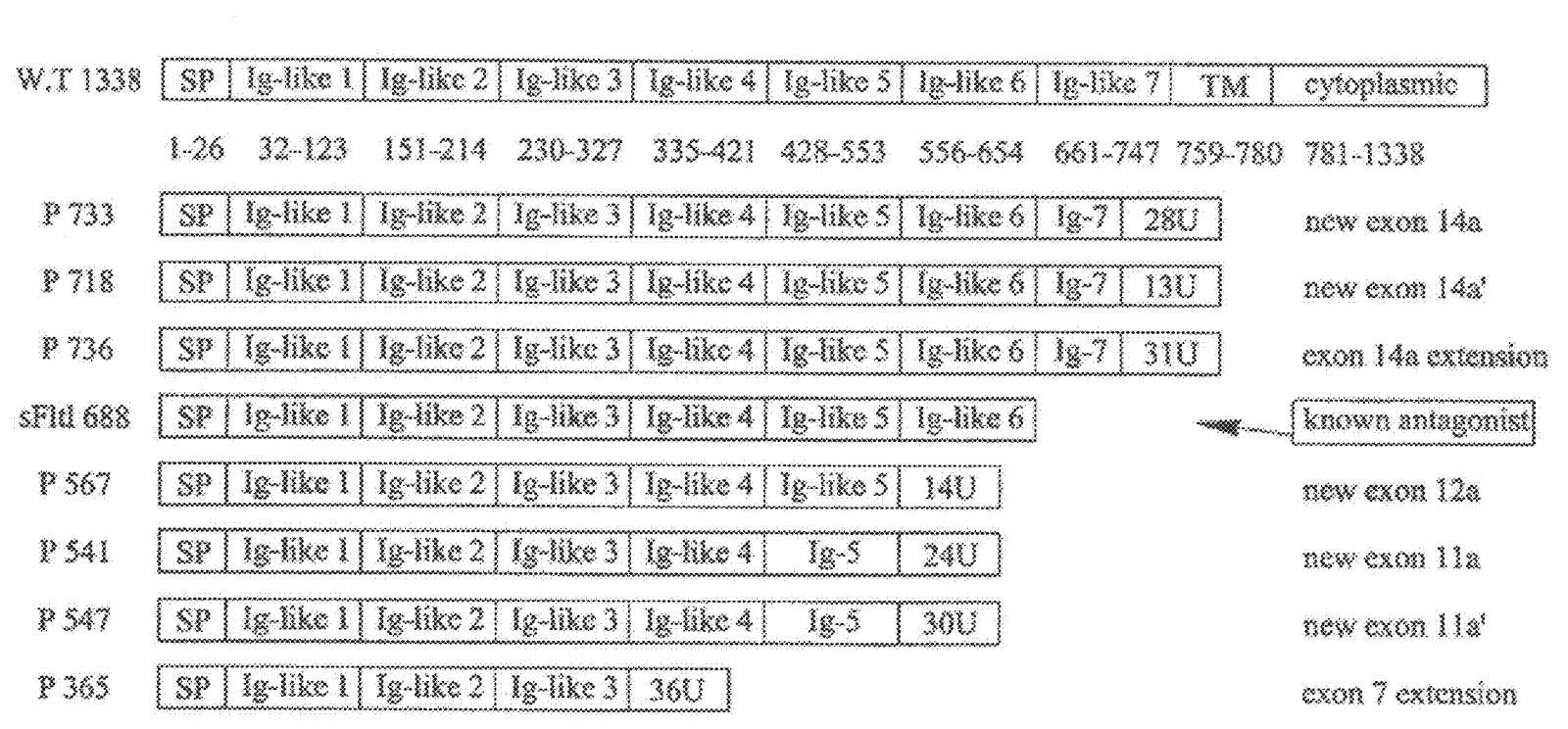

The variants were found to have the following domain structure as shown in FIG. 36.

Example 51

Description for cluster HUMKDRZ

Cluster HUMKDRZ features 2 transcript(s) and 15 segment(s) of interest, the names for which are given in Tables 132 and 133, respectively, the sequences themselves are given in SEQ ID NOs: 538-539; 540-554 and 556-557, for transcripts; segments and proteins, respectively. The selected protein variants are given in Table 134.

TABLE 132

Transcripts of interest

| Transcript Name | SEQ ID NO: |
|---|---|
| HUMKDRZ_T12 | 538 |
| HUMKDRZ_T13 | 539 |

TABLE 133

Segments of interest

| Segment Name | SEQ ID NO: |
|---|---|
| HUMKDRZ_node_0 | 540 |
| HUMKDRZ_node_6 | 541 |
| HUMKDRZ_node_8 | 542 |
| HUMKDRZ_node_10 | 543 |
| HUMKDRZ_node_12 | 544 |
| HUMKDRZ_node_14 | 545 |
| HUMKDRZ_node_18 | 546 |
| HUMKDRZ_node_19 | 547 |
| HUMKDRZ_node_21 | 548 |

TABLE 133-continued

Segments of interest

| Segment Name | SEQ ID NO: |
|---|---|
| HUMKDRZ_node_23 | 549 |
| HUMKDRZ_node_27 | 550 |
| HUMKDRZ_node_28 | 551 |
| HUMKDRZ_node_2 | 552 |
| HUMKDRZ_node_16 | 553 |
| HUMKDRZ_node_25 | 554 |

TABLE 134

Proteins of interest

| Protein Name | SEQ ID NO: | Protein Length | Corresponding Transcript(s) |
|---|---|---|---|
| HUMKDRZ_P8 | 556 | P678 | HUMKDRZ_T12 |
| HUMKDRZ_P9 | 557 | P469 | HUMKDRZ_T13 |

These sequences are variants of the known protein Vascular endothelial growth factor receptor 2 precursor (SEQ ID NO:555; SwissProt accession identifier VGR2_HUMAN; known also according to the synonyms EC 2.7.1.112; VEGFR-2; Kinase insert domain receptor; Protein-tyrosine kinase receptor Flk-1), referred to herein as the previously known protein.

Protein Vascular endothelial growth factor receptor 2 precursor is known or believed to have the following function(s): RECEPTOR FOR VEGF OR VEGF-C. HAS A TYROSINE-PROTEIN KINASE ACTIVITY. THE VEGF-KINASE LIGAND/RECEPTOR SIGNALING SYSTEM PLAYS A KEY ROLE IN VASCULAR DEVELOPMENT AND REGULATION OF VASCULAR PERMEABILITY. The sequence for protein Vascular endothelial growth factor receptor 2 precursor is given in SEQ ID NO:555, as "Vascular endothelial growth factor receptor 2 precursor amino acid sequence". Known polymorphisms for this sequence are as shown in Table 135.

TABLE 135

Amino acid mutations for Known Protein

| SNP position(s) on amino acid sequence | Comment |
|---|---|
| 2 | Q → E |
| 772 | A → T |
| 787 | R → G |
| 835 | K → N |
| 848 | V → E |
| 1347 | S → T |

Protein Vascular endothelial growth factor receptor 2 precursor localization is believed to be Type I membrane protein.

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein or of drugs directed to this protein are as follows: Endothelial growth factor receptor kinase inhibitor; Angiogenesis modulator; Endothelial growth factor modulator. A therapeutic role for a protein represented by the cluster has been predicted. The cluster was assigned this field because there was information in the drug database or the public databases (e.g., described herein above) that this protein, or part thereof, is used or can be used for a potential therapeutic indication: Cardiovascular; Vulnerary; Anticancer; Symptomatic antidiabetic.

The following GO Annotation(s) apply to the previously known protein. The following annotation(s) were found: angiogenesis; protein amino acid phosphorylation; transmembrane receptor protein tyrosine kinase signaling pathway, which are annotation(s) related to Biological Process; receptor; vascular endothelial growth factor receptor; ATP binding, which are annotation(s) related to Molecular Function; and integral plasma membrane protein, which are annotation(s) related to Cellular Component.

The GO assignment relies on information from one or more of the SwissProt/TremB1 Protein knowledgebase, or Locuslink.

As noted above, cluster HUMKDRZ features 2 transcript(s), which were listed in Table 1 above. These transcript(s) encode for protein(s) which are variant(s) of protein Vascular endothelial growth factor receptor 2 precursor. A description of each variant protein according to the present invention is now provided.

Variant protein HUMKDRZ_P8 according to the present invention is encoded by transcript(s) HUMKDRZ_T12. An alignment is given to the known protein (Vascular endothelial growth factor receptor 2 precursor) in FIG. 161. A brief description of the relationship of the variant protein according to the present invention to each such aligned protein is as follows:

Comparison Report Between HUMKDRZ_P8 and VGR2_HUMAN:

1. An isolated chimeric polypeptide HUMKDRZ_P8, comprising a first amino acid sequence being at least 90% homologous to MQSKVLLAVALWLCVETRAASVGLPSVSLDLPRLSIQKDILTIKANTTLQITCR GQRDLDWLWPNNQSGSEQRVEVTECSDGLFCKTLTIPKVIGNDTGAYKCFYR ETDLASVIYVYVQDYRSPFIASVSDQHGVVYITENKNKTVVIPCLGSISNLNVS LCARYPEKRFVPDGNRISWDSKKGFTIPSYMISYAGMVFCEAKINDESYQSIM YIVVVVGYRIYDVVLSPSHGIELSVGEKLVLNCTARTELNVGIDFNWEYPSSK HQHKKLVNRDLKTQSGSEMKKFLSTLTIDGVTRSDQGLYTCAASSGLMTKK NSTFVRVHEKPFVAFGSGMESLVEATVGERVRIPAKYLGYPPPEIKWYKNGIP LESNHTIKAGHVLTIMEVSERDTGNYTVILTNPISKEKQSHVVSLVVYVPPQIG EKSLISPVDSYQYGTTQTLTCTVYAIPPPHHIHWYWQLEEECANEPSQAVSVT NPYPCEEWRSVEDFQGGNKIEVNKNQFALIEGKNKTVSTLVIQAANVSALYK CEAVNKVGRGERVISFHVTRGPEITLQPDMQPTEQESVSLWCTADRSTFENLT WYKLGPQPLPIHVGELPTPVCKNLDTLWKLNATMFSNSTNDILIMELKNASL QDQGDYVCLAQDRKTKKRHCVVRQLTVL corresponding to amino acids 1-662 of VGR2_HUMAN, which also corresponds to amino acids 1-662 of HUMKDRZ_P8, and a second amino acid sequence being at least 70%, optionally at least 80%, preferably at least 85%, more preferably at least 90% and most preferably at least 95% homologous to a polypeptide having the sequence GRETILDHCAEAVGMP corresponding to amino acids 663-678 of HUMKDRZ_P8, wherein said first amino acid sequence and second amino acid sequence are contiguous and in a sequential order.

2. An isolated polypeptide for a tail of HUMKDRZ_P8, comprising a polypeptide being at least 70%, optionally at least about 80%, preferably at least about 85%, more preferably at least about 90% and most preferably at least about 95% homologous to the sequence GRETILDHCAEAVGMP in HUMKDRZ_P8.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMKDRZ_P8 also has the following non-silent SNPs (Single Nucleotide Polymorphisms) as listed in Table 136, (given according to their position(s) on the amino acid sequence, with the alternative amino acid(s) listed; the last column indicates whether the SNP is known or not; the presence of known SNPs in variant protein HUMKDRZ_P8 sequence provides support for the deduced sequence of this variant protein according to the present invention).

TABLE 136

Amino acid mutations

| SNP position(s) on amino acid sequence | Alternative amino acid(s) | Previously known SNP? |
|---|---|---|
| 98 | T → A | No |
| 244 | L → F | No |
| 268 | Q → R | No |
| 297 | V → I | Yes |
| 305 | Y → H | No |
| 349 | R → K | Yes |
| 392 | D → N | Yes |
| 472 | Q → H | Yes |
| 482 | C → R | No |
| 523 | N → S | No |
| 636 | D → G | No |

The glycosylation sites of variant protein HUMKDRZ_P8, as compared to the known protein Vascular endothelial growth factor receptor 2 precursor, are described in Table 137 (given according to their position(s) on the amino acid sequence in the first column; the second column indicates whether the glycosylation site is present in the variant protein; and the last column indicates whether the position is different on the variant protein).

TABLE 137

Glycosylation site(s)

| Position(s) on known amino acid sequence | Present in variant protein? | Position in variant protein? |
|---|---|---|
| 619 | yes | 619 |
| 46 | yes | 46 |
| 395 | yes | 395 |
| 66 | yes | 66 |

TABLE 137-continued

Glycosylation site(s)

| Position(s) on known amino acid sequence | Present in variant protein? | Position in variant protein? |
|---|---|---|
| 675 | no | |
| 96 | yes | 96 |
| 580 | yes | 580 |
| 143 | yes | 143 |
| 511 | yes | 511 |
| 318 | yes | 318 |
| 245 | yes | 245 |
| 158 | yes | 158 |
| 523 | yes | 523 |
| 613 | yes | 613 |
| 704 | no | |
| 631 | yes | 631 |
| 721 | no | |
| 374 | yes | 374 |

The phosphorylation sites of variant protein HUMKDRZ_P8, as compared to the known protein Vascular endothelial growth factor receptor 2 precursor, are described in Table 138 (given according to their position(s) on the amino acid sequence in the first column; the second column indicates whether the phosphorylation site is present in the variant protein; and the last column indicates whether the position is different on the variant protein).

TABLE 138

Phosphorylation site(s)

| Position(s) on known amino acid sequence | Present in variant protein? | Position in variant protein? |
|---|---|---|
| 1059 | no | |

The variant protein has the following domains, as determined by using InterPro. The domains are described in Table 139.

TABLE 139

InterPro domain(s)

| InterPro ID | Domain description | Analysis type | Position(s) on protein |
|---|---|---|---|
| IPR009134 | Vascular endothelial growth factor receptor, VEGFR | FPrintScan | 115-126, 177-187, 236-248, 383-400, 439-453, 85-103 |
| IPR009136 | Vascular endothelial growth factor receptor 2, VEGFR2 | FPrintScan | 186-199, 203-224, 449-464, 645-663 |
| IPR007110 | Immunoglobulin-like | HMMPfam | 239-309, 345-397, 438-532, 46-105, 564-644 |
| IPR003598 | Immunoglobulin C-2 type | HMMSmart | 237-314, 343-405, 436-537, 562-649 |
| IPR003599 | Immunoglobulin subtype | HMMSmart | 135-218, 231-325, 337-418, 38-119, 430-548, 556-662 |
| IPR007110 | Immunoglobulin-like | ProfileScan | 224-320, 328-414, 421-548, 551-660 |

Variant protein HUMKDRZ_P8 is encoded by the following transcript(s): HUMKDRZ_T12. The coding portion of transcript HUMKDRZ_T12 starts at position 303 and ends at position 2336. The transcript also has the following SNPs as listed in Table 140 (given according to their position on the nucleotide sequence, with the alternative nucleic acid listed; the last column indicates whether the SNP is known or not; the presence of known SNPs in variant protein HUMKDRZ_P8 sequence provides support for the deduced sequence of this variant protein according to the present invention).

TABLE 140

Nucleic acid SNPs

| SNP position on nucleotide sequence | Alternative nucleic acid | Previously known SNP? |
|---|---|---|
| 32 | G → A | Yes |
| 293 | G → T | No |
| 594 | A → G | No |
| 1034 | A → C | No |
| 1105 | A → G | No |
| 1191 | G → A | Yes |
| 1215 | T → C | No |
| 1226 | A → G | No |
| 1348 | G → A | Yes |
| 1476 | G → A | Yes |
| 1718 | A → T | Yes |
| 1746 | T → C | No |
| 1870 | A → G | No |
| 2209 | A → G | No |
| 2419 | C → T | Yes |

Variant protein HUMKDRZ_P9 according to the present invention is encoded by transcript(s) HUMKDRZ_T13. An alignment is given to the known protein (Vascular endothelial growth factor receptor 2 precursor) in FIG. 162. A brief description of the relationship of the variant protein according to the present invention to each such aligned protein is as follows:

Comparison Report Between HUMKDRZ_P9 and VGR2_HUMAN:

1. An isolated chimeric polypeptide HUMKDRZ_P9, comprising a first amino acid sequence being at least 90% homologous to MQSKVLLAVALWLCVETRAASVGLPS-VSLDLPRLSIQKDILTIKANTTLQITCR GQRDLDWLW-PNNQSGSEQRVEVTECSDGLFCKTLTIP-KVIGNDTGAYKCFYR ETDLASVIYVYVQDYRSPFIASVSDQH-GVVYITENKNKTVVIPCLGSISNLNVS LCARYPE-KRFVPDGNRISWDSKKGFTIPSYMISY-AGMVFCEAKINDESYQSIM YIVVVVGYRIYDVVLSPSHGIELSVGEK-LVLNCTARTELNVGIDFNWEYPSSK HQHKKLVN-RDLKTQSGSEMKKFLSTLTIDGVTRS-DQGLYTCAASSGLMTKK NSTFVRVHEKPFVAFGSGMESLVE-ATVGERVRIPAKYLGYPPPEIKWYKNGIP LESNHTIK-AGHVLTIMEVSERDTGNYTVILT-NPISKEKQSHVVSLVVY corresponding to amino acids 1-418 of VGR2_HUMAN, which also corresponds to amino acids 1-418 of HUMKDRZ_P9, and a second amino acid sequence being at least 70%, optionally at least 80%, preferably at least 85%, more preferably at least 90% and most preferably at least 95% homologous to a polypeptide having the sequence GESIQFSSLPKIYYDTLSSKSAKPP-FLCLLLLHSYHGWACVQKSSGVVKLK corresponding to amino acids 419-469 of HUMKDRZ_P9, wherein said first amino acid sequence and second amino acid sequence are contiguous and in a sequential order.

2. An isolated polypeptide for a tail of HUMKDRZ_P9, comprising a polypeptide being at least 70%, optionally at least about 80%, preferably at least about 85%, more preferably at least about 90% and most preferably at least about 95% homologous to the sequence GESIQFSSLPKIYY-DTLSSKSAKPPFLCLLLLHSYHG-WACVQKSSGVVKLK in HUMKDRZ_P9.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMKDRZ_P9 also has the following non-silent SNPs (Single Nucleotide Polymorphisms) as listed in Table 141, (given according to their position(s) on the amino acid sequence, with the alternative amino acid(s) listed; the last column indicates whether the SNP is known or not; the presence of known SNPs in variant protein HUMKDRZ_P9 sequence provides support for the deduced sequence of this variant protein according to the present invention).

TABLE 141

Amino acid mutations

| SNP position(s) on amino acid sequence | Alternative amino acid(s) | Previously known SNP? |
|---|---|---|
| 98 | T → A | No |
| 244 | L → F | No |
| 268 | Q → R | No |
| 297 | V → I | Yes |
| 305 | Y → H | No |
| 349 | R → K | Yes |
| 392 | D → N | Yes |

The glycosylation sites of variant protein HUMKDRZ_P9, as compared to the known protein Vascular endothelial growth factor receptor 2 precursor, are described in Table 142 (given according to their position(s) on the amino acid sequence in the first column; the second column indicates whether the glycosylation site is present in the variant protein; and the last column indicates whether the position is different on the variant protein).

TABLE 142

Glycosylation site(s)

| Position(s) on known amino acid sequence | Present in variant protein? | Position in variant protein? |
|---|---|---|
| 619 | no | |
| 46 | yes | 46 |
| 395 | yes | 395 |
| 66 | yes | 66 |
| 675 | no | |
| 96 | yes | 96 |
| 580 | no | |
| 143 | yes | 143 |
| 511 | no | |
| 318 | yes | 318 |
| 245 | yes | 245 |
| 158 | yes | 158 |
| 523 | no | |
| 613 | no | |
| 704 | no | |
| 631 | no | |
| 721 | no | |
| 374 | yes | 374 |

The phosphorylation sites of variant protein HUMKDRZ_P9, as compared to the known protein Vascular endothelial growth factor receptor 2 precursor, are described in Table 143 (given according to their position(s) on the amino acid sequence in the first column; the second column indicates whether the phosphorylation site is present in the variant protein; and the last column indicates whether the position is different on the variant protein).

TABLE 143

Phosphorylation site(s)

| Position(s) on known amino acid sequence | Present in variant protein? | Position in variant protein? |
|---|---|---|
| 1059 | no | |

The variant protein has the following domains, as determined by using InterPro. The domains are described in Table 144.

TABLE 144

InterPro domain(s)

| InterPro ID | Domain description | Analysis type | Position(s) on protein |
|---|---|---|---|
| IPR009134 | Vascular endothelial growth factor receptor, VEGFR | FPrintScan | 115-126, 177-187, 236-248, 383-400, 85-103 |
| IPR009136 | Vascular endothelial growth factor receptor 2, VEGFR2 | FPrintScan | 186-199, 203-224 |
| IPR007110 | Immunoglobulin-like | HMMPfam | 239-309, 345-397, 46-105 |
| IPR003598 | Immunoglobulin C-2 type | HMMSmart | 237-314, 343-405 |
| IPR003599 | Immunoglobulin subtype | HMMSmart | 135-218, 231-325, 337-418, 38-119 |
| IPR007110 | Immunoglobulin-like | ProfileScan | 224-320, 328-414 |

Variant protein HUMKDRZ_P9 is encoded by the following transcript(s): HUMKDRZ_T13. The coding portion of transcript HUMKDRZ_T13 starts at position 303 and ends at position 1709. The transcript also has the following SNPs as listed in Table 145 (given according to their position on the nucleotide sequence, with the alternative nucleic acid listed; the last column indicates whether the SNP is known or not; the presence of known SNPs in variant protein HUMKDRZ_P9 sequence provides support for the deduced sequence of this variant protein according to the present invention).

TABLE 145

Nucleic acid SNPs

| SNP position on nucleotide sequence | Alternative nucleic acid | Previously known SNP? |
|---|---|---|
| 32 | G → A | Yes |
| 293 | G → T | No |
| 594 | A → G | No |
| 1034 | A → C | No |
| 1105 | A → G | No |
| 1191 | G → A | Yes |
| 1215 | T → C | No |
| 1226 | A → G | No |
| 1348 | G → A | Yes |
| 1476 | G → A | Yes |
| 1676 | C → T | Yes |
| 1959 | G → A | Yes |

FIG. 203 presents the domain structure of the variants described hereinabove in comparison to the known or wild-type (WT) protein.

Example 52

Description for Cluster HUMCTLA4B

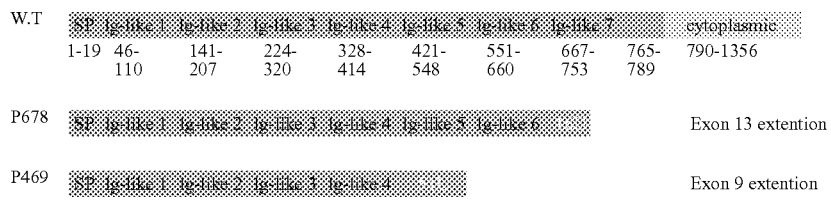

Cluster HUMCTLA4B features 1 transcript(s) and 5 segment(s) of interest, the names for which are given in Tables 146 and 147, respectively, the sequences themselves are given in SEQ ID NOs: 558; 559-563 and 565, for transcript, segments and proteins, respectively. The selected protein variants are given in Table 148.

TABLE 146

Transcripts of interest

| Transcript Name | SEQ ID NO: |
|---|---|
| HUMCTLA4B_PEA_1_T5 | 558 |

TABLE 147

Segments of interest

| Segment Name | SEQ ID NO: |
|---|---|
| HUMCTLA4B_PEA_1_node_0 | 559 |
| HUMCTLA4B_PEA_1_node_4 | 560 |
| HUMCTLA4B_PEA_1_node_10 | 561 |
| HUMCTLA4B_PEA_1_node_13 | 562 |
| HUMCTLA4B_PEA_1_node_1 | 563 |

TABLE 148

Proteins of interest

| Protein Name | SEQ ID NO: | Protein Length | Corresponding Transcript(s) |
|---|---|---|---|
| HUMCTLA4B_PEA_1_P3 | 565 | P174 | HUMCTLA4B_PEA_1_T5 |

These sequences are variants of the known protein Cytotoxic T-lymphocyte protein 4 precursor (SEQ ID NO:564; SwissProt accession identifier CTL4_HUMAN; known also according to the synonyms Cytotoxic T-lymphocyte-associated antigen 4; CTLA-4; CD152 antigen), referred to herein as the previously known protein.

Protein Cytotoxic T-lymphocyte protein 4 precursor is known or believed to have the following function(s): Possibly involved in T-cell activation. Binds to B7-1 (CD80) and B7-2 (CD86). The sequence for protein Cytotoxic T-lymphocyte protein 4 precursor is in SEQ ID NO:564, as "Cytotoxic T-lymphocyte protein 4 precursor amino acid sequence". Known polymorphisms for this sequence are as shown in Table 149.

TABLE 149

Amino acid mutations for Known Protein

| SNP position(s) on amino acid sequence | Comment |
|---|---|
| 17 | T → A (in dbSNP: 231775)./ FTId = VAR_013577. |
| 147 | T → A |

Protein Cytotoxic T-lymphocyte protein 4 precursor localization is believed to be Type I membrane protein.

The previously known protein also has the following indication(s) and/or potential therapeutic use(s): Thrombocytopenic purpura; Transplant rejection, bone marrow. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: CD28 antagonist; CTLA4 inhibitor; Immunosuppressant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Antiviral, anti-HIV; Anticancer; Antipruritic/inflamm, allergic; Immunosuppressant; Multiple sclerosis treatment; Haematological; Neurological; Immunostimulant.

The following GO Annotation(s) apply to the previously known protein. The following annotation(s) were found: immune response, which are annotation(s) related to Biological Process; and integral plasma membrane protein, which are annotation(s) related to Cellular Component.

The GO assignment relies on information from one or more of the SwissProt/TremB1 Protein knowledgebase, or Locuslink.

As noted above, cluster HUMCTLA4B features 1 transcript(s), which were listed in Table 1 above. These transcript(s) encode for protein(s) which are variant(s) of protein Cytotoxic T-lymphocyte protein 4 precursor. A description of each variant protein according to the present invention is now provided.

Variant protein HUMCTLA4B_PEA_1_P3 according to the present invention is encoded by transcript(s) HUMCTLA4B_PEA_1_T5. An alignment is given to the known protein (Cytotoxic T-lymphocyte protein 4 precursor) in FIG. 163. A brief description of the relationship of the variant protein according to the present invention to each such aligned protein is as follows:

Comparison Report Between HUMCTLA4B_PEA_1_P3 and CTL4 HUMAN:

1. An isolated chimeric polypeptide HUMCTLA4B_PEA_1_P3, comprising a first amino acid sequence being at least 90% homologous to MACLGFQRH-KAQLNLATRTWPCTLLFFLLFIPVFCKA-MHVAQPAVVLASSRG IASFVCEYASPGKATEVRVTV-LRQADSQVTEVCAATYMMGNELTFLDDSICT GTSSGNQVNLTIQGLRAMDTGLYICK-VELMYPPPYYLGIGNGTQIYVI corresponding to amino acids 1-152 of CTL4_HUMAN, which also corresponds to amino acids 1-152 of HUMCTLA4B_PEA_1_P3, and a second amino acid sequence being at least 70%, optionally at least 80%, preferably at least 85%, more preferably at least 90% and most preferably at least 95% homologous to a polypeptide having the sequence AKEKKPSYNR-GLCENAPNRARM corresponding to amino acids 153-174 of HUMCTLA4B_PEA_1_P3, wherein said first amino acid sequence and second amino acid sequence are contiguous and in a sequential order.

2. An isolated polypeptide for a tail of HUMCTLA4B_PEA_1_P3, comprising a polypeptide being at least 70%, optionally at least about 80%, preferably at least about 85%, more preferably at least about 90% and most preferably at least about 95% homologous to the sequence AKEKKPSYNRGLCENAPNRARM in HUMCTLA4B_PEA_1_P3.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCTLA4B_PEA_1_P3 also has the following non-silent SNPs (Single Nucleotide Polymorphisms) as listed in Table 150, (given according to their position(s) on the amino acid sequence, with the alternative amino acid(s) listed; the last column indicates whether the SNP is known or not; the presence of known SNPs in variant protein HUMCTLA4B_PEA_1_P3 sequence provides support for the deduced sequence of this variant protein according to the present invention).

TABLE 150

Amino acid mutations

| SNP position(s) on amino acid sequence | Alternative amino acid(s) | Previously known SNP? |
|---|---|---|
| 17 | T → A | Yes |
| 91 | M → T | Yes |

The glycosylation sites of variant protein HUMCTLA4B_PEA_1_P3, as compared to the known protein Cytotoxic T-lymphocyte protein 4 precursor, are described in Table 151 (given according to their position(s) on the amino acid sequence in the first column; the second column indicates whether the glycosylation site is present in the variant protein; and the last column indicates whether the position is different on the variant protein).

TABLE 151

Glycosylation site(s)

| Position(s) on known amino acid sequence | Present in variant protein? | Position in variant protein? |
|---|---|---|
| 113 | yes | 113 |

The variant protein has the following domains, as determined by using InterPro. The domains are described in Table 152.

TABLE 152

InterPro domain(s)

| InterPro ID | Domain description | Analysis type | Position(s) on protein |
|---|---|---|---|
| IPR008096 | Cytotoxic T-lymphocyte antigen 4 | FPrintScan | 110-122, 17-34, 36-62, 78-92 |
| IPR003596 | Immunoglobulin V-type | HMMSmart | 53-131 |
| IPR003599 | Immunoglobulin subtype | HMMSmart | 43-152 |

Variant protein HUMCTLA4B_PEA_1_P3 is encoded by the following transcript(s): HUMCTLA4B_PEA_1_T5. The coding portion of transcript HUMCTLA4B_PEA_1_T5 starts at position 420 and ends at position 941. The transcript also has the following SNPs as listed in Table 153 (given according to their position on the nucleotide sequence, with the alternative nucleic acid listed; the last column indicates whether the SNP is known or not; the presence of known SNPs in variant protein HUMCTLA4B_PEA_1_P3 sequence provides support for the deduced sequence of this variant protein according to the present invention).

TABLE 153

Nucleic acid SNPs

| SNP position on nucleotide sequence | Alternative nucleic acid | Previously known SNP? |
|---|---|---|
| 101 | C → T | Yes |
| 414 | A → | No |
| 415 | A → T | No |
| 468 | A → G | Yes |
| 691 | T → C | Yes |
| 1005 | C → | No |
| 1006 | C → A | No |
| 1356 | G → A | Yes |

Example 53

Description for Cluster HSTNFR1A

Cluster HSTNFR1A features 13 transcript(s) and 52 segment(s) of interest, the names for which are given in Tables 154 and 155, respectively, the sequences themselves are given in SEQ ID NOs: 566-578; 579-630 and 632-639, for transcripts, segments and proteins, respectively. The selected protein variants are given in Table 156.

TABLE 154

Transcripts of interest

| Transcript Name | SEQ ID NO: |
|---|---|
| HSTNFR1A_PEA_1_T8 | 566 |
| HSTNFR1A_PEA_1_T9 | 567 |
| HSTNFR1A_PEA_1_T12 | 568 |
| HSTNFR1A_PEA_1_T13 | 569 |
| HSTNFR1A_PEA_1_T15 | 570 |
| HSTNFR1A_PEA_1_T18 | 571 |
| HSTNFR1A_PEA_1_T20 | 572 |
| HSTNFR1A_PEA_1_T25 | 573 |
| HSTNFR1A_PEA_1_T26 | 574 |
| HSTNFR1A_PEA_1_T28 | 575 |
| HSTNFR1A_PEA_1_T29 | 576 |
| HSTNFR1A_PEA_1_T30 | 577 |
| HSTNFR1A_PEA_1_T37 | 578 |

TABLE 155

Segments of interest

| Segment Name | SEQ ID NO: |
|---|---|
| HSTNFR1A_PEA_1_node_12 | 579 |
| HSTNFR1A_PEA_1_node_40 | 580 |
| HSTNFR1A_PEA_1_node_42 | 581 |
| HSTNFR1A_PEA_1_node_47 | 582 |
| HSTNFR1A_PEA_1_node_49 | 583 |
| HSTNFR1A_PEA_1_node_77 | 584 |
| HSTNFR1A_PEA_1_node_81 | 585 |
| HSTNFR1A_PEA_1_node_11 | 586 |
| HSTNFR1A_PEA_1_node_13 | 587 |
| HSTNFR1A_PEA_1_node_14 | 588 |
| HSTNFR1A_PEA_1_node_15 | 589 |
| HSTNFR1A_PEA_1_node_26 | 590 |
| HSTNFR1A_PEA_1_node_27 | 591 |
| HSTNFR1A_PEA_1_node_28 | 592 |
| HSTNFR1A_PEA_1_node_29 | 593 |
| HSTNFR1A_PEA_1_node_32 | 594 |
| HSTNFR1A_PEA_1_node_33 | 595 |
| HSTNFR1A_PEA_1_node_34 | 596 |
| HSTNFR1A_PEA_1_node_35 | 597 |
| HSTNFR1A_PEA_1_node_36 | 598 |
| HSTNFR1A_PEA_1_node_38 | 599 |
| HSTNFR1A_PEA_1_node_39 | 600 |
| HSTNFR1A_PEA_1_node_41 | 601 |
| HSTNFR1A_PEA_1_node_44 | 602 |
| HSTNFR1A_PEA_1_node_45 | 603 |
| HSTNFR1A_PEA_1_node_46 | 604 |
| HSTNFR1A_PEA_1_node_48 | 605 |
| HSTNFR1A_PEA_1_node_50 | 606 |
| HSTNFR1A_PEA_1_node_51 | 607 |
| HSTNFR1A_PEA_1_node_52 | 608 |
| HSTNFR1A_PEA_1_node_55 | 609 |
| HSTNFR1A_PEA_1_node_58 | 610 |
| HSTNFR1A_PEA_1_node_59 | 611 |
| HSTNFR1A_PEA_1_node_60 | 612 |
| HSTNFR1A_PEA_1_node_61 | 613 |
| HSTNFR1A_PEA_1_node_62 | 614 |
| HSTNFR1A_PEA_1_node_63 | 615 |
| HSTNFR1A_PEA_1_node_64 | 616 |
| HSTNFR1A_PEA_1_node_65 | 617 |
| HSTNFR1A_PEA_1_node_66 | 618 |
| HSTNFR1A_PEA_1_node_67 | 619 |
| HSTNFR1A_PEA_1_node_68 | 620 |
| HSTNFR1A_PEA_1_node_70 | 621 |

TABLE 155-continued

Segments of interest

| Segment Name | SEQ ID NO: |
|---|---|
| HSTNFR1A_PEA_1_node_71 | 622 |
| HSTNFR1A_PEA_1_node_72 | 623 |
| HSTNFR1A_PEA_1_node_73 | 624 |
| HSTNFR1A_PEA_1_node_74 | 625 |
| HSTNFR1A_PEA_1_node_75 | 626 |
| HSTNFR1A_PEA_1_node_76 | 627 |
| HSTNFR1A_PEA_1_node_78 | 628 |
| HSTNFR1A_PEA_1_node_79 | 629 |
| HSTNFR1A_PEA_1_node_80 | 630 |

TABLE 156

Proteins of interest

| Protein Name | SEQ ID NO: | Protein Length | Corresponding Transcript(s) |
|---|---|---|---|
| HSTNFR1A_PEA_1_P11 | 632 | P291 | HSTNFR1A_PEA_1_T13 |
| HSTNFR1A_PEA_1_P15 | 633 | P228 | HSTNFR1A_PEA_1_T18 |
| HSTNFR1A_PEA_1_P19 | 634 | P404 | HSTNFR1A_PEA_1_T25 |
| HSTNFR1A_PEA_1_P20 | 635 | P218 | HSTNFR1A_PEA_1_T8; HSTNFR1A_PEA_1_T9; HSTNFR1A_PEA_1_T12; HSTNFR1A_PEA_1_T15; HSTNFR1A_PEA_1_T20; HSTNFR1A_PEA_1_T26 |
| HSTNFR1A_PEA_1_P22 | 636 | P247 | HSTNFR1A_PEA_1_T28 |
| HSTNFR1A_PEA_1_P23 | 637 | P242 | HSTNFR1A_PEA_1_T29 |
| HSTNFR1A_PEA_1_P24 | 638 | P219 | HSTNFR1A_PEA_1_T30 |
| HSTNFR1A_PEA_1_P28 | 639 | P184 | HSTNFR1A_PEA_1_T37 |

These sequences are variants of the known protein Tumor necrosis factor receptor superfamily member 1A precursor (SEQ ID NO:631; SwissProt accession identifier TR1A_HUMAN; known also according to the synonyms p60; TNF-R1; TNF-RI; p55; CD120a; TBPI), referred to herein as the previously known protein.

Protein Tumor necrosis factor receptor superfamily member 1A precursor is known or believed to have the following function(s): Receptor for TNFSF2/TNF-alpha and homotrimeric TNFSF1/lymphotoxin-alpha. The adaptor molecule FADD recruits caspase-8 to the activated receptor. The resulting death-inducing signaling complex (DISC) performs caspase-8 proteolytic activation which initiates the subsequent cascade of caspases (aspartate-specific cysteine proteases) mediating apoptosis. Contributes to the induction of noncytocidal TNF effects including anti-viral state and activation of the acid sphingomyelinase. The sequence for protein Tumor necrosis factor receptor superfamily member 1A precursor is given in SEQ ID NO: 631, as "Tumor necrosis factor receptor superfamily member 1A precursor amino acid sequence". Known polymorphisms for this sequence are as shown in Table 157.

TABLE 157

Amino acid mutations for Known Protein

| SNP position(s) on amino acid sequence | Comment |
|---|---|
| 59 | C → R (in FHF)./FTId = VAR_013410. |
| 62 | C → Y (in FHF)./FTId = VAR_013411. |
| 79 | T → M (in FHF)./FTId = VAR_013412. |
| 81 | C → F (in FHF)./FTId = VAR_013413. |
| 117 | C → R (in FHF)./FTId = VAR_013414. |
| 117 | C → Y (in FHF)./FTId = VAR_013415. |
| 305 | P → T (in dbSNP: 1804532)./FTId = VAR_011813. |
| 412 | Missing |
| 443-446 | GPAA → APP |

Protein Tumor necrosis factor receptor superfamily member 1A precursor localization is believed to be Type I membrane protein and secreted.

The previously known protein also has the following indication(s) and/or potential therapeutic use(s): Infection, hepatitis-C virus; Ankylosing spondylitis; Arthritis, rheumatoid; Asthma; Chronic obstructive pulmonary disease; Diabetes; Fibrosis, pulmonary; Granulomatous disease; Psoriasis; Uveitis; Arthritis, psoriatic; Multiple sclerosis; Sepsis. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein or of drugs directed against this protein are as follows: Tumour necrosis factor modulator; Tumour necrosis factor alpha modulator. A therapeutic role for a protein represented by the cluster has been predicted. The cluster was assigned this field because there was information in the drug database or the public databases (e.g., described herein above) that this protein, or part thereof, is used or can be used for a potential therapeutic indication: Immunosuppressant; Antidiabetic; Antipsoriasis; Immunomodulator, anti-infective; Antiasthma; Ophthalmological; COPD treatment; Antiarthritic, Septic shock treatment; Multiple sclerosis treatment; Antiarthritic; Anticancer; Cytokine; Cardiovascular.

The following GO Annotation(s) apply to the previously known protein. The following annotation(s) were found: apoptosis; signal transduction, which are annotation(s) related to Biological Process; receptor; tumor necrosis factor receptor, type I, which are annotation(s) related to Molecular Function; and extracellular; integral plasma membrane protein, which are annotation(s) related to Cellular Component.

The GO assignment relies on information from one or more of the SwissProt/TremB1 Protein knowledgebase, or Locuslink.

This protein is one of the major receptors for the tumor necrosis factor-alpha. TNF is produced by T-cells and activated macrophages in response to infection, by ligating TNFR1.

This protein is a type I membrane protein that is secreted. The soluble form is produced from the membrane form by proteolytic processing. Binding of TNF to the extracellular domain leads to homotrimerization. This complex activates at least two distinct signaling cascades, apoptosis and NF-kappa-B signaling.
Germline mutations of the extracellular domains of this receptor were found to be associated with the autosomal dominant periodic fever syndrome.

As noted above, cluster HSTNFR1A features 13 transcript(s), which were listed in Table 1 above. These transcript(s) encode for protein(s) which are variant(s) of protein Tumor necrosis factor receptor superfamily member 1A precursor. A description of each variant protein according to the present invention is now provided.

Variant protein HSTNFR1A_PEA_1_P11 according to the present invention is encoded by transcript(s) HSTNFR1A_PEA_1_T13. An alignment is given to the known protein (Tumor necrosis factor receptor superfamily member 1A precursor) in FIG. 164. A brief description of the relationship of the variant protein according to the present invention to each such aligned protein is as follows:

Comparison Report Between HSTNFR1A_PEA_1_P11 and TR1A_HUMAN:

1. An isolated chimeric polypeptide HSTNFR1A_PEA_1_P11, comprising a first amino acid sequence being at least 90% homologous to MGLSTVPDLLLPLVLLELLVGIYPS-GVIGLVPHLGDREKRDSVCPQGKYIHPQ NNSICCT-KCHKGTYLYNDCPGPGQDTDCRECESGS-FTASENHLRHCLSCSKCR KEMGQVEISSCTVDRDTVCGCRKNQY-RHYWSENLFQCFNCSLCLNGTVHLS C corresponding to amino acids 1-158 of 1A_HUMAN, which also corresponds to amino acids 1-158 of HSTNFR1A_PEA_1_P11, a second amino acid sequence being at least 70%, optionally at least 80%, preferably at least 85%, more preferably at least 90% and most preferably at least 95% homologous to a polypeptide having the sequence ERSSPEAKPSPHPRGW-PLPHAVALPFLPPPVFCGSDNQLLSGRPHPVPRHFLCP VGWGCRRFSFSCAALLPTG corresponding to amino acids 159-231 of HSTNFR1A_PEA_1_P11, a third amino acid sequence being at least 90% homologous to QEKQNTVCTCHAGFFLRENECVSCS corresponding to amino acids 159-183 of TR1A_HUMAN, which also corresponds to amino acids 232-256 of HSTNFR1A_PEA_1_P11, and a fourth amino acid sequence being at least 70%, optionally at least 80%, preferably at least 85%, more preferably at least 90% and most preferably at least 95% homologous to a polypeptide having the sequence KVLLCRPG-WNAVARSRLTATSASQIQAILLLQPPK corresponding to amino acids 257-291 of HSTNFR1A_PEA_1_P11, wherein said first amino acid sequence, second amino acid sequence, third amino acid sequence and fourth amino acid sequence are contiguous and in a sequential order.

2. An isolated polypeptide for an edge portion of HSTNFR1A_PEA_1_P11, comprising an amino acid sequence being at least 70%, optionally at least about 80%, preferably at least about 85%, more preferably at least about 90% and most preferably at least about 95% homologous to the sequence encoding for ERSSPEAKPSPHPRGWPL-PHAVALPFLPPPVFCGSDNQLLSGRPHPVPRHFLCP VGWGCRRFSFSCAALLPTG, corresponding to HSTNFR1A_PEA_1_P11.

3. An isolated polypeptide for a tail of HSTNFR1A_PEA_1_P11, comprising a polypeptide being at least 70%, optionally at least about 80%, preferably at least about 85%, more preferably at least about 90% and most preferably at least about 95% homologous to the sequence KVLLCRPGWNA-VARSRLTATSASQIQAILLLQPPK in HSTNFR1A_PEA_1_P11.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSTNFR1A_PEA_1_P11 also has the following non-silent SNPs (Single Nucleotide Polymorphisms) as listed in Table 158, (given according to their position(s) on the amino acid sequence, with the alternative amino acid(s) listed; the last column indicates whether the SNP is known or not; the presence of known SNPs in variant protein HSTNFR1A_PEA_1_P11 sequence provides support for the deduced sequence of this variant protein according to the present invention).

TABLE 158

Amino acid mutations

| SNP position(s) on amino acid sequence | Alternative amino acid(s) | Previously known SNP? |
|---|---|---|
| 45 | P → S | No |
| 75 | P → L | Yes |
| 121 | R → Q | Yes |
| 179 | A → V | Yes |
| 185 | L → R | Yes |
| 220 | F → S | Yes |
| 223 | S → N | Yes |

The glycosylation sites of variant protein HSTNFR1A_PEA_1_P11, as compared to the known protein Tumor necrosis factor receptor superfamily member 1A precursor, are described in Table 159 (given according to their position(s) on the amino acid sequence in the first column; the second column indicates whether the glycosylation site is present in the variant protein; and the last column indicates whether the position is different on the variant protein).

TABLE 159

Glycosylation site(s)

| Position(s) on known amino acid sequence | Present in variant protein? | Position in variant protein? |
|---|---|---|
| 54 | yes | 54 |
| 151 | yes | 151 |
| 145 | yes | 145 |

The variant protein has the following domains, as determined by using InterPro. The domains are described in Table 160.

TABLE 160

InterPro domain(s)

| InterPro ID | Domain description | Analysis type | Position(s) on protein |
|---|---|---|---|
| IPR001368 | TNFR/CD27/30/40/95 cysteine-rich region | HMMPfam | 44-81, 84-125 |
| IPR001368 | TNFR/CD27/30/40/95 cysteine-rich region | HMMSmart | 127-165, 241-269, 44-81, 84-125 |
| IPR000345 | Cytochrome c heme-binding site | ScanRegExp | 59-64 |
| IPR001368 | TNFR/CD27/30/40/95 cysteine-rich region | ScanRegExp | 44-81, 84-125 |
| IPR006209 | EGF-like domain | ScanRegExp | 239-252 |
| IPR001368 | TNFR/CD27/30/40/95 cysteine-rich region | ProfileScan | 43-81, 83-125 |

Variant protein HSTNFR1A_PEA_1_P11 is encoded by the following transcript(s): HSTNFR1A_PEA_1_T13. The coding portion of transcript HSTNFR1A_PEA_1_T13 starts at position 282 and ends at position 1154. The transcript also has the following SNPs as listed in Table 161 (given according to their position on the nucleotide sequence, with the alternative nucleic acid listed; the last column indicates whether the SNP is known or not; the presence of known SNPs in variant protein HSTNFR1A_PEA_1_P11 sequence provides support for the deduced sequence of this variant protein according to the present invention).

TABLE 161

Nucleic acid SNPs

| SNP position on nucleotide sequence | Alternative nucleic acid | Previously known SNP? |
|---|---|---|
| 102 | T → | No |
| 267 | C → T | No |
| 317 | A → G | Yes |
| 414 | C → T | No |
| 505 | C → T | Yes |
| 643 | G → A | Yes |
| 817 | C → T | Yes |
| 835 | T → G | Yes |
| 940 | T → C | Yes |
| 949 | G → A | Yes |
| 1526 | A → G | Yes |
| 1703 | A → T | Yes |
| 2363 | C → | No |
| 2480 | C → A | Yes |
| 2867 | C → T | Yes |
| 2943 | C → | No |
| 3130 | G → A | Yes |

TABLE 161-continued

Nucleic acid SNPs

| SNP position on nucleotide sequence | Alternative nucleic acid | Previously known SNP? |
|---|---|---|
| 3268 | G → A | Yes |
| 3470 | A → T | Yes |

Variant protein HSTNFR1A_PEA_1_P15 according to the present invention is encoded by transcript(s) HSTNFR1A_PEA_1_T18. An alignment is given to the known protein (Tumor necrosis factor receptor superfamily member 1A precursor) in FIG. 165. A brief description of the relationship of the variant protein according to the present invention to each such aligned protein is as follows:

Comparison Report Between HSTNFR1A_PEA_1_P15 and TR1A_HUMAN:

1. An isolated chimeric polypeptide HSTNFR1A_PEA_1_P15, comprising a first amino acid sequence being at least 90% homologous to MGLSTVPDLLLPLVLLELLVGIYPS-GVIGLVPHLGDREKRDSVCPQGKYIHPQ NNSICCT-KCHKGTYLYNDCPGPGQDTDCRECESGS-FTASENHLRHCLSCSKCR KEMGQVEISSCTVDRDTVCGCRKNQY-RHYWSENLFQCFNCSLCLNGTVHLS CQEKQNTVCTCHAGFFLRENECVSCS corresponding to amino acids 1-183 of TR1A_HUMAN, which also corresponds to amino acids 1-183 of HSTNFR1A_PEA_1_P15, and a second amino acid sequence being at least 70%, optionally at least 80%, preferably at least 85%, more preferably at least 90% and most preferably at least 95% homologous to a polypeptide having the sequence KHHSAVAPGHFLWS-LPFIPPLHWFNVSLPTVEVQALLHCLWEIDT corresponding to amino acids 184-228 of HSTNFR1A_PEA_1_P15, wherein said first amino acid sequence and second amino acid sequence are contiguous and in a sequential order.

2. An isolated polypeptide for a tail of HSTNFR1A_PEA_1_P15, comprising a polypeptide being at least 70%, optionally at least about 80%, preferably at least about 85%, more preferably at least about 90% and most preferably at least about 95% homologous to the sequence KHHSAVAPGHFL-WSLPFIPPLHWFNVSLPTVEVQALLHCLWEIDT in HSTNFR1A_PEA_1_P15.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSTNFR1A_PEA_1_P15 also has the following non-silent SNPs (Single Nucleotide Polymorphisms) as listed in Table 162, (given according to their position(s) on the amino acid sequence, with the alternative amino acid(s) listed; the last column indicates whether the SNP is known or not; the presence of known SNPs in variant protein HSTNFR1A_PEA_1_P15 sequence provides support for the deduced sequence of this variant protein according to the present invention).

TABLE 162

Amino acid mutations

| SNP position(s) on amino acid sequence | Alternative amino acid(s) | Previously known SNP? |
|---|---|---|
| 45 | P → S | No |
| 75 | P → L | Yes |
| 121 | R → Q | Yes |

The glycosylation sites of variant protein HSTNFR1A_PEA_1_P15, as compared to the known protein Tumor necrosis factor receptor superfamily member 1A precursor, are described in Table 163 (given according to their position(s) on the amino acid sequence in the first column; the second column indicates whether the glycosylation site is present in the variant protein; and the last column indicates whether the position is different on the variant protein).

TABLE 163

Glycosylation site(s)

| Position(s) on known amino acid sequence | Present in variant protein? | Position in variant protein? |
|---|---|---|
| 54 | yes | 54 |
| 151 | yes | 151 |
| 145 | yes | 145 |

The variant protein has the following domains, as determined by using InterPro. The domains are described in Table 164.

TABLE 164

InterPro domain(s)

| InterPro ID | Domain description | Analysis type | Position(s) on protein |
|---|---|---|---|
| IPR001368 | TNFR/CD27/30/40/95 cysteine-rich region | HMMPfam | 127-166, 44-81, 84-125 |
| IPR001368 | TNFR/CD27/30/40/95 cysteine-rich region | HMMSmart | 127-166, 44-81, 84-125 |
| IPR000345 | Cytochrome c heme-binding site | ScanRegExp | 59-64 |
| IPR001368 | TNFR/CD27/30/40/95 cysteine-rich region | ScanRegExp | 127-166, 44-81, 84-125 |

TABLE 164-continued

InterPro domain(s)

| InterPro ID | Domain description | Analysis type | Position(s) on protein |
|---|---|---|---|
| IPR006209 | EGF-like domain | ScanRegExp | 166-179 |
| IPR001368 | TNFR/CD27/30/40/95 cysteine-rich region | ProfileScan | 126-166, 43-81, 83-125 |

Variant protein HSTNFR1A_PEA_1_P15 is encoded by the following transcript(s): HSTNFR1A_PEA_1_T18. The coding portion of transcript HSTNFR1A_PEA_1_T18 starts at position 282 and ends at position 965. The transcript also has the following SNPs as listed in Table 165 (given according to their position on the nucleotide sequence, with the alternative nucleic acid listed; the last column indicates whether the SNP is known or not; the presence of known SNPs in variant protein HSTNFR1A_PEA_1_P15 sequence provides support for the deduced sequence of this variant protein according to the present invention).

TABLE 165

Nucleic acid SNPs

| SNP position on nucleotide sequence | Alternative nucleic acid | Previously known SNP? |
|---|---|---|
| 102 | T → | No |
| 267 | C → T | No |
| 317 | A → G | Yes |
| 414 | C → T | No |
| 505 | C → T | Yes |
| 643 | G → A | Yes |
| 1003 | C → | No |
| 1120 | C → A | Yes |
| 1507 | C → T | Yes |
| 1583 | C → | No |
| 1770 | G → A | Yes |
| 1908 | G → A | Yes |
| 2110 | A → T | Yes |

Variant protein HSTNFR1A_PEA_1_P19 according to the present invention is encoded by transcript(s) HSTNFR1A_PEA_1_T25. An alignment is given to the known protein (Tumor necrosis factor receptor superfamily member 1A precursor) in FIG. 166. A brief description of the relationship of the variant protein according to the present invention to each such aligned protein is as follows:

Comparison Report Between HSTNFR1A_PEA_1_P19 and TR1A_HUMAN:

1. An isolated chimeric polypeptide HSTNFR1A_PEA_1_P19, comprising a first amino acid sequence being at least 90% homologous to MGLSTVPDLLLPLVLLELLVGIYPS-GVIGLVPHLGDREKRDSVCPQGKYIHPQ NNSICCT-KCHKGTYLYNDCPGPGQDTDCRECESGS-FTASENHLRHCLSCSKCR KEMGQVEISSCTVDRDTVCGCRKNQY-RHYWSENLFQCFNCSLCLNGTVHLS CQEKQNTVCTCHAGFFLRENECVSC-SNCKKSLECTKLCLPQIENVKGTEDSGT TVLL corresponding to amino acids 1-214 of TR1A_HUMAN, which also corresponds to amino acids 1-214 of HSTNFR1A_PEA_1_P19, and a second amino acid sequence being at least 90% homologous to PLAPNPSFSPT-PGFTPTLGFSPVPSSTFTSSSTYTPGD-CPNFAAPRREVAPPYQG ADPILATALASDPIPNPLQK-WEDSAHKPQSLDTDDPATLYAVVENVPPLRWK EFVRRLGLSDHEIDRLELQNGRCL- REAQYSMLATWRRRTPRREATLELLGRV LRDM-DLLGCLEDIEEALCGPAALPPAPSLLR corresponding to amino acids 266-455 of TR1A_HUMAN, which also corresponds to amino acids 215-404 of HSTNFR1A_PEA_1_P19, wherein said first amino acid sequence and second amino acid sequence are contiguous and in a sequential order.

2. An isolated chimeric edge portion of HSTNFR1A_PEA_1_P19, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LP, having a structure as follows: a sequence starting from any of amino acid numbers 214-x to 214; and ending at any of amino acid numbers 215+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSTNFR1A_PEA_1_P19 also has the following non-silent SNPs (Single Nucleotide Polymorphisms) as listed in Table 166, (given according to their position(s) on the amino acid sequence, with the alternative amino acid(s) listed; the last column indicates whether the SNP is known or not; the presence of known SNPs in variant protein HSTNFR1A_PEA_1_P19 sequence provides support for the deduced sequence of this variant protein according to the present invention).

TABLE 166

Amino acid mutations

| SNP position(s) on amino acid sequence | Alternative amino acid(s) | Previously known SNP? |
|---|---|---|
| 45 | P → S | No |
| 75 | P → L | Yes |
| 121 | R → Q | Yes |
| 254 | P → T | Yes | glycosylation sites of variant protein HSTNFR1A_PEA_1_P19, as compared to the known protein Tumor necrosis factor receptor superfamily member 1A precursor, are described in Table 167 (given according to their position(s) on the amino acid sequence in the first column; the second column indicates whether the glycosylation site is present in the variant protein; and the last column indicates whether the position is different on the variant protein).

TABLE 167

Glycosylation site(s)

| Position(s) on known amino acid sequence | Present in variant protein? | Position in variant protein? |
|---|---|---|
| 54 | yes | 54 |
| 151 | yes | 151 |
| 145 | yes | 145 |

The variant protein has the following domains, as determined by using InterPro. The domains are described in Table 168.

TABLE 168

InterPro domain(s)

| InterPro ID | Domain description | Analysis type | Position(s) on protein |
|---|---|---|---|
| IPR001368 | TNFR/CD27/30/40/95 cysteine-rich region | HMMPfam | 127-166, 44-81, 84-125 |
| IPR000488 | Death domain | HMMPfam | 306-390 |
| IPR000488 | Death domain | HMMSmart | 294-390 |
| IPR001368 | TNFR/CD27/30/40/95 cysteine-rich region | HMMSmart | 127-166, 168-195, 44-81, 84-125 |
| IPR000345 | Cytochrome c heme-binding site | ScanRegExp | 59-64 |
| IPR001368 | TNFR/CD27/30/40/95 cysteine-rich region | ScanRegExp | 127-166, 44-81, 84-125 |
| IPR006209 | EGF-like domain | ScanRegExp | 166-179 |
| IPR000488 | Death domain | ProfileScan | 305-390 |
| IPR001368 | TNFR/CD27/30/40/95 cysteine-rich region | ProfileScan | 126-166, 43-81, 83-125 |

Variant protein HSTNFR1A_PEA_1_P19 is encoded by the following transcript(s): HSTNFR1A_PEA_1_T25. The coding portion of transcript HSTNFR1A_PEA_1_T25 starts at position 282 and ends at position 1493. The transcript also has the following SNPs as listed in Table 169 (given according to their position on the nucleotide sequence, with the alternative nucleic acid listed; the last column indicates whether the SNP is known or not; the presence of known SNPs in variant protein HSTNFR1A_PEA_1_P19 sequence provides support for the deduced sequence of this variant protein according to the present invention).

TABLE 169

Nucleic acid SNPs

| SNP position on nucleotide sequence | Alternative nucleic acid | Previously known SNP? |
|---|---|---|
| 102 | T → | No |
| 267 | C → T | No |
| 317 | A → G | Yes |
| 414 | C → T | No |
| 505 | C → T | Yes |
| 643 | G → A | Yes |
| 1041 | C → A | Yes |
| 1428 | C → T | Yes |
| 1504 | C → | No |
| 1691 | G → A | Yes |
| 1829 | G → A | Yes |
| 2031 | A → T | Yes |

Variant protein HSTNFR1A_PEA_1_P20 according to the present invention is encoded by transcript(s) HSTNFR1A_PEA_1_T8, HSTNFR1A_PEA_1_T9, HSTNFR1A_PEA_1_T12, HSTNFR1A_PEA_1_T15, HSTNFR1A_PEA_1_T20 and HSTNFR1A_PEA_1_T26. An alignment is given to the known protein (Tumor necrosis factor receptor superfamily member 1A precursor) in FIG. 167. A brief description of the relationship of the variant protein according to the present invention to each such aligned protein is as follows:

Comparison Report Between HSTNFR1A_PEA_1_P20 and TR1A_HUMAN:

1. An isolated chimeric polypeptide HSTNFR1A_PEA_1_P20, comprising a first amino acid sequence being at least 90% homologous to MGLSTVPDLLLPLVLLELLVGIYPS-GVIGLVPHLGDREKRDSVCPQGKYIHPQ NNSICCT-KCHKGTYLYNDCPGPGQDTDCRECESGS-FTASENHLRHCLSCSKCR KEMGQVEISSCTVDRDTVCGCRKNQY- RHYWSENLFQCFNCSLCLNGTVHLS CQEKQNTVCTCHAGFFLRENECVSCS corresponding to amino acids 1-183 of TR1A_HUMAN, which also corresponds to amino acids 1-183 of HSTNFR1A_PEA_1_P20, and a second amino acid sequence being at least 70%, optionally at least 80%, preferably at least 85%, more preferably at least 90% and most preferably at least 95% homologous to a polypeptide having the sequence KVLLCRPGWNAVARSRLTATSASQIQAILLLQPPK corresponding to amino acids 184-218 of HSTNFR1A_PEA_1_P20, wherein said first amino acid sequence and second amino acid sequence are contiguous and in a sequential order.

2. An isolated polypeptide for a tail of HSTNFR1A_PEA_1_P20, comprising a polypeptide being at least 70%, optionally at least 80%, preferably at least 85%, more preferably at least about 90% and most preferably at least about 95% homologous to the sequence KVLLCRPGWNAVARSRLTATSASQIQAILLLQPPK in HSTNFR1A_PEA_1_P20.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSTNFR1A_PEA_1_P20 also has the following non-silent SNPs (Single Nucleotide Polymorphisms) as listed in Table 170, (given according to their position(s) on the amino acid sequence, with the alternative amino acid(s) listed; the last column indicates whether the SNP is known or not; the presence of known SNPs in variant protein HSTNFR1A_PEA_1_P20 sequence provides support for the deduced sequence of this variant protein according to the present invention).

TABLE 170

Amino acid mutations

| SNP position(s) on amino acid sequence | Alternative amino acid(s) | Previously known SNP? |
|---|---|---|
| 45 | P → S | No |
| 75 | P → L | Yes |
| 121 | R → Q | Yes |

The glycosylation sites of variant protein HSTNFR1A_PEA_1_P20, as compared to the known protein Tumor necrosis factor receptor superfamily member 1A precursor, are described in Table 171 (given according to their position(s) on the amino acid sequence in the first column; the second column indicates whether the glycosylation site is present in the variant protein; and the last column indicates whether the position is different on the variant protein).

TABLE 171

Glycosylation site(s)

| Position(s) on known amino acid sequence | Present in variant protein? | Position in variant protein? |
|---|---|---|
| 54 | yes | 54 |
| 151 | yes | 151 |
| 145 | yes | 145 |

The variant protein has the following domains, as determined by using InterPro. The domains are described in Table 172.

TABLE 172

InterPro domain(s)

| InterPro ID | Domain description | Analysis type | Position(s) on protein |
|---|---|---|---|
| IPR001368 | TNFR/CD27/30/40/95 cysteine-rich region | HMMPfam | 127-166, 44-81, 84-125 |
| IPR001368 | TNFR/CD27/30/40/95 cysteine-rich region | HMMSmart | 127-166, 168-196, 44-81, 84-125 |
| IPR000345 | Cytochrome c heme-binding site | ScanRegExp | 59-64 |
| IPR001368 | TNFR/CD27/30/40/95 cysteine-rich region | ScanRegExp | 127-166, 44-81, 84-125 |
| IPR006209 | EGF-like domain | ScanRegExp | 166-179 |
| IPR001368 | TNFR/CD27/30/40/95 cysteine-rich region | ProfileScan | 126-166, 43-81, 83-125 |

Variant protein HSTNFR1A_PEA_1_P20 is encoded by the following transcript(s): HSTNFR1A_PEA_1_T8, HSTNFR1A_PEA_1_T9, HSTNFR1A_PEA_1_T12, HSTNFR1A_PEA_1_T15 and HSTNFR1A_PEA_1_T20.

The coding portion of transcript HSTNFR1A_PEA_1_T8 starts at position 282 and ends at position 935. The transcript also has the following SNPs as listed in Table 173 (given according to their position on the nucleotide sequence, with the alternative nucleic acid listed; the last column indicates whether the SNP is known or not; the presence of known SNPs in variant protein HSTNFR1A_PEA_1_P20 sequence provides support for the deduced sequence of this variant protein according to the present invention).

TABLE 173

Nucleic acid SNPs

| SNP position on nucleotide sequence | Alternative nucleic acid | Previously known SNP? |
|---|---|---|
| 102 | T → | No |
| 267 | C → T | No |
| 317 | A → G | Yes |
| 414 | C → T | No |
| 505 | C → T | Yes |
| 643 | G → A | Yes |
| 1195 | C → | No |
| 1312 | C → A | Yes |
| 1699 | C → T | Yes |
| 1775 | C → | No |
| 1962 | G → A | Yes |
| 2100 | G → A | Yes |
| 2302 | A → T | Yes |

The coding portion of transcript HSTNFR1A_PEA_1_T9 starts at position 282 and ends at position 935. The transcript also has the following SNPs as listed in Table 174 (given according to their position on the nucleotide sequence, with the alternative nucleic acid listed; the last column indicates whether the SNP is known or not; the presence of known SNPs in variant protein HSTNFR1A_PEA_1_P20 sequence provides support for the deduced sequence of this variant protein according to the present invention).

TABLE 174

Nucleic acid SNPs

| SNP position on nucleotide sequence | Alternative nucleic acid | Previously known SNP? |
|---|---|---|
| 102 | T → | No |
| 267 | C → T | No |
| 317 | A → G | Yes |
| 414 | C → T | No |
| 505 | C → T | Yes |
| 643 | G → A | Yes |
| 1307 | A → G | Yes |
| 1484 | A → T | Yes |
| 2144 | C → | No |
| 2261 | C → A | Yes |
| 2648 | C → T | Yes |
| 2724 | C → | No |
| 2911 | G → A | Yes |
| 3049 | G → A | Yes |
| 3251 | A → T | Yes |

The coding portion of transcript HSTNFR1A_PEA_1_T12 starts at position 282 and ends at position 935. The transcript also has the following SNPs as listed in Table 175 (given according to their position on the nucleotide sequence, with the alternative nucleic acid listed; the last column indicates whether the SNP is known or not; the presence of known SNPs in variant protein HSTNFR1A_PEA_1_P20 sequence provides support for the deduced sequence of this variant protein according to the present invention).

TABLE 175

Nucleic acid SNPs

| SNP position on nucleotide sequence | Alternative nucleic acid | Previously known SNP? |
|---|---|---|
| 102 | T → | No |
| 267 | C → T | No |
| 317 | A → G | Yes |
| 414 | C → T | No |
| 505 | C → T | Yes |
| 643 | G → A | Yes |
| 1307 | A → G | Yes |
| 1484 | A → T | Yes |
| 1983 | G → A | Yes |
| 2086 | C → T | Yes |
| 2285 | C → | No |
| 2402 | C → A | Yes |
| 2789 | C → T | Yes |
| 2865 | C → | No |
| 3052 | G → A | Yes |
| 3190 | G → A | Yes |
| 3392 | A → T | Yes |

The coding portion of transcript HSTNFR1A_PEA_1_T15 starts at position 282 and ends at position 935. The transcript also has the following SNPs as listed in Table 176 (given according to their position on the nucleotide sequence, with the alternative nucleic acid listed; the last column indicates whether the SNP is known or not; the presence of known SNPs in variant protein HSTNFR1A_PEA_1_P20 sequence provides support for the deduced sequence of this variant protein according to the present invention).

TABLE 176

Nucleic acid SNPs

| SNP position on nucleotide sequence | Alternative nucleic acid | Previously known SNP? |
|---|---|---|
| 102 | T → | No |
| 267 | C → T | No |
| 317 | A → G | Yes |
| 414 | C → T | No |
| 505 | C → T | Yes |
| 643 | G → A | Yes |
| 1199 | C → | No |
| 1316 | C → A | Yes |
| 1703 | C → T | Yes |
| 1779 | C → | No |
| 1966 | G → A | Yes |
| 2104 | G → A | Yes |
| 2306 | A → T | Yes |

The coding portion of transcript HSTNFR1A_PEA_1_T20 starts at position 282 and ends at position 935. The transcript also has the following SNPs as listed in Table 177 (given according to their position on the nucleotide sequence, with the alternative nucleic acid listed; the last column indicates whether the SNP is known or not; the presence of known SNPs in variant protein HSTNFR1A_PEA_1_P20 sequence provides support for the deduced sequence of this variant protein according to the present invention).

TABLE 177

Nucleic acid SNPs

| SNP position on nucleotide sequence | Alternative nucleic acid | Previously known SNP? |
|---|---|---|
| 102 | T → | No |
| 267 | C → T | No |
| 317 | A → G | Yes |
| 414 | C → T | No |
| 505 | C → T | Yes |
| 643 | G → A | Yes |
| 1121 | C → | No |
| 1238 | C → A | Yes |
| 1625 | C → T | Yes |
| 1701 | C → | No |
| 1888 | G → A | Yes |
| 2026 | G → A | Yes |
| 2228 | A → T | Yes |

Variant protein HSTNFR1A_PEA_1_P20 is encoded by the following transcript(s): HSTNFR1A_PEA_1_T26. The coding portion of transcript HSTNFR1A_PEA_1_T26 starts at position 282 and ends at position 935. The transcript also has the following SNPs as listed in Table 178 (given according to their position on the nucleotide sequence, with the alternative nucleic acid listed; the last column indicates whether the SNP is known or not; the presence of known SNPs in variant protein HSTNFR1A_PEA_1_P20 sequence provides support for the deduced sequence of this variant protein according to the present invention).

TABLE 178

Nucleic acid SNPs

| SNP position on nucleotide sequence | Alternative nucleic acid | Previously known SNP? |
|---|---|---|
| 102 | T → | No |
| 267 | C → T | No |
| 317 | A → G | Yes |

TABLE 178-continued

Nucleic acid SNPs

| SNP position on nucleotide sequence | Alternative nucleic acid | Previously known SNP? |
|---|---|---|
| 414 | C → T | No |
| 505 | C → T | Yes |
| 643 | G → A | Yes |
| 1195 | C → | No |
| 1275 | C → A | Yes |
| 1662 | C → T | Yes |
| 1738 | C → | No |
| 1925 | G → A | Yes |
| 2063 | G → A | Yes |
| 2265 | A → T | Yes |

Variant protein HSTNFR1A_PEA_1_P22 according to the present invention is encoded by transcript(s) HSTNFR1A_PEA_1_T28. An alignment is given to the known protein (Tumor necrosis factor receptor superfamily member 1A precursor) in FIG. 168. A brief description of the relationship of the variant protein according to the present invention to each such aligned protein is as follows:

Comparison Report Between HSTNFR1A_PEA_1_P22 and TR1A_HUMAN:

1. An isolated chimeric polypeptide HSTNFR1A_PEA_1_P22, comprising a first amino acid sequence being at least 90% homologous to MGLSTVPDLLLPLVLLELLVGIYPS-GVIGLVPHLGDREKRDSVCPQGKYIHPQ NNSICCT-KCHKGTYLYNDCPGPGQDTDCRECESGS-FTASENHLRHCLSCSKCR KEMGQVEISSCTVDRDTVCGCRKNQY-RHYWSENLFQCFNCSLCLNGTVHLS CQEKQNTVCTCHAGFFLRENECVSC-SNCKKSLECTKLCLPQIENVKGTEDS corresponding to amino acids 1-208 of TR1A_HUMAN, which also corresponds to amino acids 1-208 of HSTNFR1A_PEA_1_P22, and a second amino acid sequence being at least 70%, optionally at least 80%, preferably at least 85%, more preferably at least 90% and most preferably at least 95% homologous to a polypeptide having the sequence ERWHHPIRGLTPSL-RQPSPPTPSPTPFRSGRTAPTSHRA corresponding to amino acids 209-247 of HSTNFR1A_PEA_1_P22, wherein said first amino acid sequence and second amino acid sequence are contiguous and in a sequential order.

2. An isolated polypeptide for a tail of HSTNFR1A_PEA_1_P22, comprising a polypeptide being at least 70%, optionally at least about 80%, preferably at least about 85%, more preferably at least about 90% and most preferably at least about 95% homologous to the sequence ERWHHPIR-GLTPSLRQPSPPTPSPTPFRSGRTAPTSHRA in HSTNFR1A_PEA_1_P22.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSTNFR1A_PEA_1_P22 also has the following non-silent SNPs (Single Nucleotide Polymorphisms) as listed in Table 179, (given according to their position(s) on the amino acid sequence, with the alternative amino acid(s) listed; the last column indicates whether the SNP is known or not; the presence of known SNPs in variant protein HSTNFR1A_PEA_1_P22 sequence provides support for the deduced sequence of this variant protein according to the present invention).

TABLE 179

Amino acid mutations

| SNP position(s) on amino acid sequence | Alternative amino acid(s) | Previously known SNP? |
|---|---|---|
| 45 | P → S | No |
| 75 | P → L | Yes |
| 121 | R → Q | Yes |

The glycosylation sites of variant protein HSTNFR1A_PEA_1_P22, as compared to the known protein Tumor necrosis factor receptor superfamily member 1A precursor, are described in Table 180 (given according to their position(s) on the amino acid sequence in the first column; the second column indicates whether the glycosylation site is present in the variant protein; and the last column indicates whether the position is different on the variant protein).

TABLE 180

Glycosylation site(s)

| Position(s) on known amino acid sequence | Present in variant protein? | Position in variant protein? |
|---|---|---|
| 54 | yes | 54 |
| 151 | yes | 151 |
| 145 | yes | 145 |

The variant protein has the following domains, as determined by using InterPro. The domains are described in Table 181.

TABLE 181

InterPro domain(s)

| InterPro ID | Domain description | Analysis type | Position(s) on protein |
|---|---|---|---|
| IPR001368 | TNFR/CD27/30/40/95 cysteine-rich region | HMMPfam | 127-166, 44-81, 84-125 |
| IPR001368 | TNFR/CD27/30/40/95 cysteine-rich region | HMMSmart | 127-166, 168-195, 44-81, 84-125 |
| IPR000345 | Cytochrome c heme-binding site | ScanRegExp | 59-64 |

TABLE 181-continued

| | InterPro domain(s) | | |
|---|---|---|---|
| InterPro ID | Domain description | Analysis type | Position(s) on protein |
| IPR001368 | TNFR/CD27/30/40/ 95 cysteine-rich region | ScanRegExp | 127-166, 44-81, 84-125 |
| IPR006209 | EGF-like domain | ScanRegExp | 166-179 |
| IPR001368 | TNFR/CD27/30/40/ 95 cysteine-rich region | ProfileScan | 126-166, 43-81, 83-125 |

Variant protein HSTNFR1A_PEA_1_P22 is encoded by the following transcript(s): HSTNFR1A_PEA_1_T28. The coding portion of transcript HSTNFR1A_PEA_1_T28 starts at position 282 and ends at position 1022. The transcript also has the following SNPs as listed in Table 182 (given according to their position on the nucleotide sequence, with the alternative nucleic acid listed; the last column indicates whether the SNP is known or not; the presence of known SNPs in variant protein HSTNFR1A_PEA_1_P22 sequence provides support for the deduced sequence of this variant protein according to the present invention).

TABLE 182

| Nucleic acid SNPs | | |
|---|---|---|
| SNP position on nucleotide sequence | Alternative nucleic acid | Previously known SNP? |
| 102 | T → | No |
| 267 | C → T | No |
| 317 | A → G | Yes |
| 414 | C → T | No |
| 505 | C → T | Yes |
| 643 | G → A | Yes |
| 1271 | C → T | Yes |
| 1347 | C → | No |
| 1534 | G → A | Yes |
| 1672 | G → A | Yes |
| 1874 | A → T | Yes |

Variant protein HSTNFR1A_PEA_1_P23 according to the present invention is encoded by transcript(s) HSTNFR1A_PEA_1_T29. An alignment is given to the known protein (Tumor necrosis factor receptor superfamily member 1A precursor) in FIG. 169. A brief description of the relationship of the variant protein according to the present invention to each such aligned protein is as follows:

Comparison Report Between HSTNFR1A_PEA_1_P23 and TR1A_HUMAN:

1. An isolated chimeric polypeptide HSTNFR1A_PEA_1_P23, comprising a first amino acid sequence being at least 90% homologous to MGLSTVPDLLLPLVLLELLVGIYPS-GVIGLVPHLGDREKRDSVCPQGKYIHPQ NNSICCT-KCHKGTYLYNDCPGPGQDTDCRECESGS-FTASENHLRHCLSCSKCR KEMGQVEISSCTVDRDTVCGCRKNQY-RHYWSENLFQCFNCSLCLNGTVHLS CQEKQNTVCTCHAGFFLRENECVSCS corresponding to amino acids 1-183 of TR1A_HUMAN, which also corresponds to amino acids 1-183 of HSTNFR1A_PEA_1_P23, and a second amino acid sequence being at least 70%, optionally at least 80%, preferably at least 85%, more preferably at least 90% and most preferably at least 95% homologous to a polypeptide having the sequence KVLLCRPGWNAVARSR-LTATSASQIQAILLLQPPKLHPHPGLQSRAQFHLHLQ LHLYPR corresponding to amino acids 184-242 of HSTNFR1A_PEA_1_P23, wherein said first amino acid sequence and second amino acid sequence are contiguous and in a sequential order.

2. An isolated polypeptide for a tail of HSTNFR1A_PEA_1_P23, comprising a polypeptide being at least 70%, optionally at least about 80%, preferably at least about 85%, more preferably at least about 90% and most preferably at least about 95% homologous to the sequence KVLLCRPGWNA-VARSRLTATSASQIQAILLLQPPKLHPH-PGLQSRAQFHLHLQ LHLYPR in HSTNFR1A_PEA_1_P23.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSTNFR1A_PEA_1_P23 also has the following non-silent SNPs (Single Nucleotide Polymorphisms) as listed in Table 183, (given according to their position(s) on the amino acid sequence, with the alternative amino acid(s) listed; the last column indicates whether the SNP is known or not; the presence of known SNPs in variant protein HSTNFR1A_PEA_1_P23 sequence provides support for the deduced sequence of this variant protein according to the present invention).

TABLE 183

| Amino acid mutations | | |
|---|---|---|
| SNP position(s) on amino acid sequence | Alternative amino acid(s) | Previously known SNP? |
| 45 | P → S | No |
| 75 | P → L | Yes |
| 121 | R → Q | Yes |

The glycosylation sites of variant protein HSTNFR1A_PEA_1_P23, as compared to the known protein Tumor necrosis factor receptor superfamily member 1A precursor, are described in Table 184 (given according to their position(s) on the amino acid sequence in the first column; the second column indicates whether the glycosylation site is present in the variant protein; and the last column indicates whether the position is different on the variant protein).

TABLE 184

| Glycosylation site(s) | | |
| --- | --- | --- |
| Position(s) on known amino acid sequence | Present in variant protein? | Position in variant protein? |
| 54 | yes | 54 |
| 151 | yes | 151 |
| 145 | yes | 145 |

The variant protein has the following domains, as determined by using InterPro. The domains are described in Table 185.

TABLE 185

| InterPro domain(s) | | | |
| --- | --- | --- | --- |
| InterPro ID | Domain description | Analysis type | Position(s) on protein |
| IPR001368 | TNFR/CD27/30/40/95 cysteine-rich region | HMMPfam | 127-166, 44-81, 84-125 |
| IPR001368 | TNFR/CD27/30/40/95 cysteine-rich region | HMMSmart | 127-166, 168-196, 44-81, 84-125 |
| IPR000345 | Cytochrome c heme-binding site | ScanRegExp | 59-64 |
| IPR001368 | TNFR/CD27/30/40/95 cysteine-rich region | ScanRegExp | 127-166, 44-81, 84-125 |
| IPR006209 | EGF-like domain | ScanRegExp | 166-179 |
| IPR001368 | TNFR/CD27/30/40/95 cysteine-rich region | ProfileScan | 126-166, 43-81, 83-125 |

Variant protein HSTNFR1A_PEA_1_P23 is encoded by the following transcript(s): HSTNFR1A_PEA_1_T29. The coding portion of transcript HSTNFR1A_PEA_1_T29 starts at position 282 and ends at position 1007. The transcript also has the following SNPs as listed in Table 186 (given according to their position on the nucleotide sequence, with the alternative nucleic acid listed; the last column indicates whether the SNP is known or not; the presence of known SNPs in variant protein HSTNFR1A_PEA_1_P23 sequence provides support for the deduced sequence of this variant protein according to the present invention).

TABLE 186

| Nucleic acid SNPs | | |
| --- | --- | --- |
| SNP position on nucleotide sequence | Alternative nucleic acid | Previously known SNP? |
| 102 | T → | No |
| 267 | C → T | No |
| 317 | A → G | Yes |
| 414 | C → T | No |
| 505 | C → T | Yes |
| 643 | G → A | Yes |
| 1015 | C → A | Yes |
| 1402 | C → T | Yes |
| 1478 | C → | No |
| 1665 | G → A | Yes |
| 1803 | G → A | Yes |
| 2005 | A → T | Yes |

Variant protein HSTNFR1A_PEA_1_P24 according to the present invention is encoded by transcript(s) HSTNFR1A_PEA_1_T30. An alignment is given to the known protein (Tumor necrosis factor receptor superfamily member 1A precursor) in FIG. 170. A brief description of the relationship of the variant protein according to the present invention to each such aligned protein is as follows:

Comparison Report Between HSTNFR1A_PEA_1_P24 and TR1A_HUMAN:

1. An isolated chimeric polypeptide HSTNFR1A_PEA_1_P24, comprising a first amino acid sequence being at least 90% homologous to MGLSTVPDLLLPLVLLELLVGIYPS-GVIGLVPHLGDREKRDSVCPQGKYIHPQ NNSICCT-KCHKGTYLYNDCPGPGQDTDCRECESGS-FTASENHLRHCLSCSKCR KEMGQVEISSCTVDRDTVCGCRKNQY-RHYWSENLFQCFNCSLCLNGTVHLS CQEKQNTVCTCHAGFFLRENECVSC-SNCKKSLECTKLCLPQIENVKGTEDSGT TVLLPLV corresponding to amino acids 1-217 of TR1A_HUMAN, which also corresponds to amino acids 1-217 of HSTNFR1A_PEA_1_P24, and a second amino acid sequence being at least 70%, optionally at least 80%, preferably at least 85%, more preferably at least 90% and most preferably at least 95% homologous to a polypeptide having the sequence RP corresponding to amino acids 218-219 of HSTNFR1A_PEA_1_P24, wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSTNFR1A_PEA_1_P24 also has the following non-silent SNPs (Single Nucleotide Polymorphisms) as listed in Table 187, (given according to their position(s) on the amino acid sequence, with the alternative amino acid(s) listed; the last column indicates whether the SNP is known or not; the presence of known SNPs in variant protein HSTNFR1A_PEA_1_P24 sequence provides support for the deduced sequence of this variant protein according to the present invention).

TABLE 187

Amino acid mutations

| SNP position(s) on amino acid sequence | Alternative amino acid(s) | Previously known SNP? |
|---|---|---|
| 45 | P → S | No |
| 75 | P → L | Yes |
| 121 | R → Q | Yes |

The glycosylation sites of variant protein HSTNFR1A_PEA_1_P24, as compared to the known protein Tumor necrosis factor receptor superfamily member 1A precursor, are described in Table 188 (given according to their position(s) on the amino acid sequence in the first column; the second column indicates whether the glycosylation site is present in the variant protein; and the last column indicates whether the position is different on the variant protein).

TABLE 188

Glycosylation site(s)

| Position(s) on known amino acid sequence | Present in variant protein? | Position in variant protein? |
|---|---|---|
| 54 | yes | 54 |
| 151 | yes | 151 |
| 145 | yes | 145 |

The variant protein has the following domains, as determined by using InterPro. The domains are described in Table 189.

TABLE 189

InterPro domain(s)

| InterPro ID | Domain description | Analysis type | Position(s) on protein |
|---|---|---|---|
| IPR001368 | TNFR/CD27/30/40/95 cysteine-rich region | HMMPfam | 127-166, 44-81, 84-125 |
| IPR001368 | TNFR/CD27/30/40/95 cysteine-rich region | HMMSmart | 127-166, 168-195, 44-81, 84-125 |
| IPR000345 | Cytochrome c heme-binding site | ScanRegExp | 59-64 |
| IPR001368 | TNFR/CD27/30/40/95 cysteine-rich region | ScanRegExp | 127-166, 44-81, 84-125 |
| IPR006209 | EGF-like domain | ScanRegExp | 166-179 |
| IPR001368 | TNFR/CD27/30/40/95 cysteine-rich region | ProfileScan | 126-166, 43-81, 83-125 |

Variant protein HSTNFR1A_PEA_1_P24 is encoded by the following transcript(s): HSTNFR1A_PEA_1_T30. The coding portion of transcript HSTNFR1A_PEA_1_T30 starts at position 282 and ends at position 938. The transcript also has the following SNPs as listed in Table 190 (given according to their position on the nucleotide sequence, with the alternative nucleic acid listed; the last column indicates whether the SNP is known or not; the presence of known SNPs in variant protein HSTNFR1A_PEA_1_P24 sequence provides support for the deduced sequence of this variant protein according to the present invention).

TABLE 190

Nucleic acid SNPs

| SNP position on nucleotide sequence | Alternative nucleic acid | Previously known SNP? |
|---|---|---|
| 102 | T → | No |
| 267 | C → T | No |
| 317 | A → G | Yes |
| 414 | C → T | No |
| 505 | C → T | Yes |
| 643 | G → A | Yes |
| 956 | G → A | Yes |
| 1158 | A → T | Yes |
| 1389 | C → T | Yes |

Variant protein HSTNFR1A_PEA_1_P28 according to the present invention is encoded by transcript(s) HSTNFR1A_PEA_1_T37. An alignment is given to the known protein (Tumor necrosis factor receptor superfamily member 1A precursor) in FIG. 171. A brief description of the relationship of the variant protein according to the present invention to each such aligned protein is as follows:

Comparison Report Between HSTNFR1A_PEA_1_P28 and TR1A_HUMAN:

1. An isolated chimeric polypeptide HSTNFR1A_PEA_1_P28, comprising a first amino acid sequence being at least 90% homologous to MGLSTVPDLLLPLVLLELLVGIYPS-GVIGLVPHLGDREKRDSVCPQGKYIHPQ NNSICCT-KCHKGTYLYNDCPGPGQDTDCRECESGS-FTASENHLRHCLSCSKCR KEMGQVEISSCTVDRDTVCGCRKNQY-RHYWSENLFQCFNCSLCLNGTVHLS CQEKQNTVCTCHAGFFLRENECVSCS corresponding to amino acids 1-183 of TR1A_HUMAN, which also corresponds to amino acids 1-183 of HSTNFR1A_PEA_1_P28, and a second amino acid sequence being at least 70%, optionally at least 80%, preferably at least 85%, more preferably at least 90% and most preferably at least 95% homologous to a polypeptide having the sequence K corresponding to amino acids 184-184 of HSTNFR1A_PEA_1_P28, wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSTNFR1A_PEA_1_P28 also has the following non-silent SNPs (Single Nucleotide Polymorphisms) as listed in Table 191, (given according to their position(s) on the amino acid sequence, with the alternative amino acid(s) listed; the last column indicates whether the SNP is known or not; the presence of known SNPs in variant protein HSTNFR1A_PEA_1_P28 sequence provides support for the deduced sequence of this variant protein according to the present invention).

TABLE 191

Amino acid mutations

| SNP position(s) on amino acid sequence | Alternative amino acid(s) | Previously known SNP? |
|---|---|---|
| 45 | P → S | No |
| 75 | P → L | Yes |
| 121 | R → Q | Yes |

The glycosylation sites of variant protein HSTNFR1A_PEA_1_P28, as compared to the known protein Tumor necrosis factor receptor superfamily member 1A precursor, are described in Table 192 (given according to their position(s) on the amino acid sequence in the first column; the second column indicates whether the glycosylation site is present in the variant protein; and the last column indicates whether the position is different on the variant protein).

TABLE 192

Glycosylation site(s)

| Position(s) on known amino acid sequence | Present in variant protein? | Position in variant protein? |
|---|---|---|
| 54 | yes | 54 |
| 151 | yes | 151 |
| 145 | yes | 145 |

The variant protein has the following domains, as determined by using InterPro. The domains are described in Table 193.

TABLE 193

InterPro domain(s)

| InterPro ID | Domain description | Analysis type | Position(s) on protein |
|---|---|---|---|
| IPR001368 | TNFR/CD27/30/40/95 cysteine-rich region | HMMPfam | 127-166, 44-81, 84-125 |
| IPR001368 | TNFR/CD27/30/40/95 cysteine-rich region | HMMSmart | 127-166, 44-81, 84-125 |
| IPR000345 | Cytochrome c heme-binding site | ScanRegExp | 59-64 |
| IPR001368 | TNFR/CD27/30/40/95 cysteine-rich region | ScanRegExp | 127-166, 44-81, 84-125 |

TABLE 193-continued

InterPro domain(s)

| InterPro ID | Domain description | Analysis type | Position(s) on protein |
|---|---|---|---|
| IPR006209 | EGF-like domain | ScanRegExp | 166-179 |
| IPR001368 | TNFR/CD27/30/40/95 cysteine-rich region | ProfileScan | 126-166, 43-81, 83-125 |

Variant protein HSTNFR1A_PEA_1_P28 is encoded by the following transcript(s): HSTNFR1A_PEA_1_T37. The coding portion of transcript HSTNFR1A_PEA_1_T37 starts at position 282 and ends at position 833. The transcript also has the following SNPs as listed in Table 194 (given according to their position on the nucleotide sequence, with the alternative nucleic acid listed; the last column indicates whether the SNP is known or not; the presence of known SNPs in variant protein HSTNFR1A_PEA_1_P28 sequence provides support for the deduced sequence of this variant protein according to the present invention).

TABLE 194

Nucleic acid SNPs

| SNP position on nucleotide sequence | Alternative nucleic acid | Previously known SNP? |
|---|---|---|
| 102 | T → | No |
| 267 | C → T | No |
| 317 | A → G | Yes |
| 414 | C → T | No |
| 505 | C → T | Yes |
| 643 | G → A | Yes |
| 1066 | A → G | Yes |
| 1207 | G → T | Yes |
| 1444 | T → C | Yes |
| 1444 | T → G | Yes |
| 1445 | G → C | Yes |
| 1558 | C → T | Yes |
| 1719 | G → C | Yes |

FIG. 204 presents the domain structure of the variants described hereinabove by a comparison to the known or wild-type (WT) protein:

Example 54

Description for Cluster HUMC5

Cluster HUMC5 features 3 transcript(s) and 24 segment(s) of interest, the names for which are given in Tables 195 and 196, respectively, the sequences themselves are given in SEQ ID NOs: 700-702; 703-726 and 727-729, for transcripts; segments and proteins, respectively. The selected protein variants are given in Table 197.

TABLE 195

Transcripts of interest

| Transcript Name | SEQ ID NO: |
|---|---|
| HUMC5_PEA_3_T11 | 700 |
| HUMC5_PEA_3_T14 | 701 |
| HUMC5_PEA_3_T16 | 702 |

TABLE 196

Segments of interest

| Segment Name | SEQ ID NO: |
|---|---|
| HUMC5_PEA_3_node_6 | 703 |
| HUMC5_PEA_3_node_8 | 704 |
| HUMC5_PEA_3_node_21 | 705 |
| HUMC5_PEA_3_node_23 | 706 |
| HUMC5_PEA_3_node_27 | 707 |
| HUMC5_PEA_3_node_29 | 708 |
| HUMC5_PEA_3_node_30 | 709 |
| HUMC5_PEA_3_node_32 | 710 |
| HUMC5_PEA_3_node_34 | 711 |
| HUMC5_PEA_3_node_36 | 712 |
| HUMC5_PEA_3_node_40 | 713 |
| HUMC5_PEA_3_node_47 | 714 |
| HUMC5_PEA_3_node_49 | 715 |
| HUMC5_PEA_3_node_4 | 716 |
| HUMC5_PEA_3_node_10 | 717 |
| HUMC5_PEA_3_node_13 | 718 |
| HUMC5_PEA_3_node_15 | 719 |
| HUMC5_PEA_3_node_17 | 720 |
| HUMC5_PEA_3_node_19 | 721 |
| HUMC5_PEA_3_node_25 | 722 |
| HUMC5_PEA_3_node_38 | 723 |
| HUMC5_PEA_3_node_42 | 724 |
| HUMC5_PEA_3_node_44 | 725 |
| HUMC5_PEA_3_node_45 | 726 |

TABLE 197

Proteins of interest

| Protein Name | SEQ ID NO: | Protein Length | Corresponding Transcript(s) |
|---|---|---|---|
| HUMC5_PEA_3_P12 | 727 | P902 | HUMC5_PEA_3_T11 |
| HUMC5_PEA_3_P13 | 728 | P505 | HUMC5_PEA_3_T14 |
| HUMC5_PEA_3_P15 | 729 | P297 | HUMC5_PEA_3_T16 |

These sequences are variants of the known protein Complement C5 precursor (SEQ ID NO:730) [Contains: C5a anaphylatoxin] (SwissProt accession identifier CO5_HUMAN SEQ ID NO:730)), referred to herein as the previously known protein.

Protein Complement C5 precursor (SEQ ID NO:730) [Contains: C5a anaphylatoxin] is known or believed to have the following function(s): Activation of C5 by a C5 convertase initiates the spontaneous assembly of the late complement components, $C_5$-$C_9$, into the membrane attack complex. C5b has a transient binding site for C6. The C5b-C6 complex is the foundation upon which the lytic complex is assembled; Derived from proteolytic degradation of complement C5, C5 anaphylatoxin is a mediator of local inflammatory process. It induces the contraction of smooth muscle, increases vascular permeability and causes histamine release from mast cells and basophilic leukocytes. C5a also stimulates the locomotion of polymorphonuclear leukocytes (chemokinesis) and direct their migration toward sites of inflammation (chemotaxis). The sequence for protein Complement C5 precursor (SEQ ID NO:730) [Contains: C5a anaphylatoxin] is given in SEQ ID NO: 730, as "Complement C5 precursor [Contains: C5a anaphylatoxin] amino acid sequence". Known polymorphisms for this sequence are as shown in Table 198.

TABLE 198

Amino acid mutations for Known Protein

| SNP position(s) on amino acid sequence | Comment |
|---|---|
| 518 | F → S. /FTId = VAR_001996. |
| 802 | I → V (in dbSNP: 17611). /FTId = VAR_014574. |
| 1053 | M → L (in dbSNP: 17609). /FTId = VAR_014575. |
| 1310 | S → N (in dbSNP: 17610). /FTId = VAR_014576. |
| 1437 | E → D (in dbSNP: 17612). /FTId = VAR_014577. |

The previously known protein also has the following indication(s) and/or potential therapeutic use(s): Inflammation; Asthma; Haemorrhage; Anaemia; Pemphigus; Psoriasis; Nephritis; Lupus nephritis; Arthritis, rheumatoid; Infarction, myocardial; Ischaemia, cerebral. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein or of drugs directed against this protein are as follows: C5a inhibitor; Complement factor C5 stimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Dermatological; Antipsoriasis; Urological; Immunosuppressant; Antiarthritic; Septic shock treatment; Respiratory; antibody; Anti-inflammatory; Haemostatic; Cardiovascular; Antiasthma; Neuroprotective.

The following GO Annotation(s) apply to the previously known protein. The following annotation(s) were found: activation of MAPK; chemotaxis; stress response; inflammatory response; complement activation, alternative pathway; complement activation, classical pathway; G-protein coupled receptor protein signaling pathway; response to pathogenic bacteria, which are annotation(s) related to Biological Process; antibacterial peptide; proteinase inhibitor; ligand; chemokine, which are annotation(s) related to Molecular Function; and membrane attack complex; extracellular space, which are annotation(s) related to Cellular Component.

The GO assignment relies on information from one or more of the SwissProt/TremB1 Protein knowledgebase, or Locuslink.

As noted above, cluster HUMC5 features 3 transcript(s), which were listed in Table 195 above. These transcript(s) encode for protein(s) which are variant(s) of protein Complement C5 precursor [Contains: C5a anaphylatoxin]. A description of each variant protein according to the present invention is now provided.

Variant protein HUMC5_PEA_3_P12 (SEQ ID NO:727) according to the present is encoded by transcript(s) HUMC5_PEA_3_T11 (SEQ ID NO:700). An alignment is given to the known protein (Complement C5 precursor [Contains: C5a anaphylatoxin]) in FIG. 172. A brief description of the relationship of the variant protein according to the present invention to each such aligned protein is as follows:

Comparison Report Between HUMC5_PEA_3_P12 (SEQ ID NO:727) and CO5_HUMAN_V1 (SEQ ID NO:730):

1. An isolated chimeric polypeptide HUMC5_PEA_3_P12 (SEQ ID NO:727), comprising a first amino acid sequence being at least 90% homologous to MGLLGILCFLIFLGKTWGQEQTYVISAP-KIFRVGASENIVIQVYGYTEAFDATIS IKSYPDKKF-SYSSGHVHLSSENKFQNSAILTIQP-KQLPGGQNPVSYVYLEVVSK HFSKSKRMPITYDNGFLFIHTDKPVYTP-DQSVKVRVYSLNDDLKPAKRETVLT FIDPEGSEVDM-VEEIDHIGIISFPDFKIPSNPRYGMW-TIKAKYKEDFSTTGTAYF EVKEYVLPHFSVSIEPEYNFIGYKNFKN-FEITIKARYFYNKVVTEADVYITFGIR EDLKD-DQKEMMQTAMQNTMLINGIAQVTFD-SETAVKELSYYSLEDLNNKYL YIAVTVIESTGGFSEEAEIPGIKYVL-SPYKLNLVATPLFLKPGIPYPIKVQVKDS LDQLVG-GVPV corresponding to amino acids 1-388 of CO5_HUMAN_V1, which also corresponds to amino acids 1-388 of HUMC5_PEA_3_P12 (SEQ ID NO:727), a bridging amino acid T corresponding to amino acid 389 of HUMC5_PEA_3_P12 (SEQ ID NO:727), a second amino acid sequence being at least 90% homologous to LNAQTID-VNQETSDLDPSKSVTRVDDGVASFVLN-LPSGVTVLEFNVKTDAPD LPEENQAREGYRAIAY-SSLSQSYLYIDWTDNHKALLVGEHLNIIVTPKSPYIDK ITHYNYLILSKGKIIHFGTREKFS-DASYQSINIPVTQNMVPSSRLLVYYIVTGEQ TAELVS-DSVWLNIEEKCGNQLQVHLSPDADAY-SPGQTVSLNMATGMDSWVA LAAVDSAVYGVQRGAKKPLERVFQFLE-KSDLGCGAGGGLNNANVFHLAGLT FLTNAN-ADDSQENDEPCKEILRPRRTLQKKIEE-IAAKYKHSVVKKCCYDGAC VNNDETCEQRAARISLGPRCIKAFTEC-CVVASQLRANISHKDMQLGRLHMKT LLPVSKPEIRSYFPESWLW-EVHLVPRRKQLQFALPDSLTTWEIQGVGISNTGIC VADTVKAKVFKDVFLEMNIPYSVVRGE-QIQLKGTVYNYRTSGMQ corresponding to amino acids 390-854 of CO5_HUMAN_V1 (SEQ ID NO:730), which also corresponds to amino acids 390-854 of HUMC5_PEA_3_P12 (SEQ ID NO:727), and a third amino acid sequence being at least 70%, optionally at least 80%, preferably at least 85%, more preferably at least 90% and most preferably at least 95% homologous to a polypeptide having the sequence SLALSPRLECNGKISGHCKLRLPGSSD-SPASASQVAGITGTHHHAQPT corresponding to amino acids 855-902 of HUMC5_PEA_3_P12 (SEQ ID NO:727), wherein said first amino acid sequence, bridging amino acid, second amino acid sequence and third amino acid sequence are contiguous and in a sequential order.

2. An isolated polypeptide for a tail of HUMC5_PEA_3_P12 (SEQ ID NO:727), comprising a polypeptide being at least 70%, optionally at least 80%, preferably at least about 85%, more preferably at least about 90% and most preferably at least about 95% homologous to the sequence SLALSPRLECNGKISGHCKLRLPGSSD-SPASASQVAGITGTHHHAQPT in HUMC5_PEA_3_P12 (SEQ ID NO:727).

It should be noted that the known protein sequence (CO5_HUMAN SEQ ID NO:730) has one or more changes than the sequence given in SEQ ID NO: 731 and named as being the amino acid sequence for CO5_HUMAN_V1. These changes were previously known to occur and are listed in the Table below.

TABLE 199

| Changes to CO5_HUMAN_V1 | |
|---|---|
| SNP position(s) on amino acid sequence | Type of change |
| 802 | variant |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMC5_PEA_3_P12 (SEQ ID NO:727) also has the following non-silent SNPs (Single Nucleotide Polymorphisms) as listed in Table 200, (given according to their position(s) on the amino acid sequence, with the alternative amino acid(s) listed; the last column indicates whether the SNP is known or not; the presence of known SNPs in variant protein HUMC5_PEA_3_P12 (SEQ ID NO:727) sequence provides support for the deduced sequence of this variant protein according to the present invention).

TABLE 200

| Amino acid mutations | | |
|---|---|---|
| SNP position(s) on amino acid sequence | Alternative amino acid(s) | Previously known SNP? |
| 74 | S → P | No |
| 449 | R → G | Yes |
| 691 | K → * | No |
| 777 | V → I | Yes |
| 802 | V → I | Yes |

The variant protein has the following domains, as determined by using InterPro. The domains are described in Table 201:

TABLE 201

| InterPro domain(s) | | | |
|---|---|---|---|
| InterPro ID | Domain description | Analysis type | Position(s) on protein |
| IPR001840 | Complement C3a/C4a/C5a anaphylatoxin | FPrintScan | 694-703, 710-721, 723-734 |
| IPR000020 | Anaphylatoxin/fibulin | HMMPfam | 698-732 |
| IPR002890 | Alpha-2-macroglobulin, N-terminal | HMMPfam | 3-633 |
| IPR000020 | Anaphylatoxin/fibulin | HMMSmart | 698-732 |
| IPR000020 | Anaphylatoxin/fibulin | ScanRegExp | 698-732 |

TABLE 201-continued

| InterPro domain(s) | | | |
|---|---|---|---|
| InterPro ID | Domain description | Analysis type | Position(s) on protein |
| IPR000020 | Anaphylatoxin/fibulin | BlastProDom | 684-751 |
| IPR000020 | Anaphylatoxin/fibulin | ProfileScan | 698-732 |

Variant protein HUMC5_PEA_3_P12 (SEQ ID NO:727) is encoded by the following transcript(s): HUMC5_PEA_3_T11 (SEQ ID NO:700). The coding portion of transcript HUMC5_PEA_3_T11 (SEQ ID NO:700) starts at position 32 and ends at position 2737. The transcript also has the following SNPs as listed in Table 202 (given according to their position on the nucleotide sequence, with the alternative nucleic acid listed; the last column indicates whether the SNP is known or not; the presence of known SNPs in variant protein HUMC5_PEA_3_P12 (SEQ ID NO:727) sequence provides support for the deduced sequence of this variant protein according to the present invention).

TABLE 202

| Nucleic acid SNPs | | |
|---|---|---|
| SNP position on nucleotide sequence | Alternative nucleic acid | Previously known SNP? |
| 1 | A → T | No |
| 251 | T → C | No |
| 1186 | A → G | Yes |
| 1376 | A → G | Yes |
| 1492 | C → T | Yes |
| 1513 | C → T | Yes |
| 1564 | C → T | Yes |
| 1663 | C → T | Yes |
| 1756 | G → A | Yes |
| 2102 | A → T | No |
| 2360 | G → A | Yes |
| 2435 | G → A | Yes |
| 2602 | C → T | Yes |

Variant protein HUMC5_PEA_3_P13 (SEQ ID NO:728) according to the present is encoded by transcript(s) HUMC5_PEA_3_T14 (SEQ ID NO:701). An alignment is given to the known protein (Complement C5 precursor [Contains: C5a anaphylatoxin]) in FIG. 173. A brief description of the relationship of the variant protein according to the present invention to each such aligned protein is as follows:

Comparison Report Between HUMC5_PEA_3_P13 (SEQ ID NO:728) and CO5_HUMAN (SEQ ID NO:730):

1. An isolated chimeric polypeptide HUMC5_PEA_3_P13 (SEQ ID NO:728), comprising a first amino acid sequence being at least 90% homologous to MGLLGILCFLIFLGKTWGQEQTYVISAP-KIFRVGASENIVIQVYGYTEAFDATIS IKSYPDKKF-SYSSGHVHLSSENKFQNSAILTIQP-KQLPGGQNPVSYVYLEVVSK HFSKSKRMPITYDNGFLFIHTDKPVYTP-DQSVKVRVYSLNDDLKPAKRETVLT FIDPEGSEVDM-VEEIDHIGIISFPDFKIPSNPRYGMW-TIKAKYKEDFSTTGTAYF EVKEYVLPHFSVSIEPEYNFIGYKNFKN-FEITIKARYFYNKVVTEADVYITFGIR EDLKD-DQKEMMQTAMQNTMLINGIAQVTFD-SETAVKELSYYSLEDLNNKYL YIAVTVIESTGGFSEEAEIPGIKYVL-SPYKLNLVATPLFLKPGIPYPIKVQVKDS LDQLVG-GVPV corresponding to amino acids 1-388 of CO5_HUMAN (SEQ ID NO:730), which also corresponds to amino acids 1-388 of HUMC5_PEA_3_P13 (SEQ ID NO:728), a bridging amino acid T corresponding to amino acid 389 of HUMC5_PEA_3_P13 (SEQ ID NO:728), a second amino acid sequence being at least 90% homologous to LNAQTIDVNQETSDLDPSKS-VTRVDDGVASFVLNLPSGVTVLEFNVKTDAPD LPEENQAREGYRAIAYSSLSQSYLYID-WTDNHKALLVGEHLNIIVTPKSPYIDK ITHYNYL corresponding to amino acids 390-502 of CO5_HUMAN (SEQ ID NO:730), which also corresponds to amino acids 390-502 of HUMC5_PEA_3_P13 (SEQ ID NO:728), and a third amino acid sequence being at least 70%, optionally at least 80%, preferably at least 85%, more preferably at least 90% and most preferably at least 95% homologous to a polypeptide having the sequence VST corresponding to amino acids 503-505 of HUMC5_PEA_3_P13 (SEQ ID NO:728), wherein said first amino acid sequence, bridging amino acid, second amino acid sequence and third amino acid sequence are contiguous and in a sequential order.

2. An isolated polypeptide for a tail of HUMC5_PEA_3_P13 (SEQ ID NO:728), comprising a polypeptide being at least 70%, optionally at least about 80%, preferably at least about 85%, more preferably at least about 90% and most preferably at least about 95% homologous to the sequence VST in HUMC5_PEA_3_P13 (SEQ ID NO:728).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMC5_PEA_3_P13 (SEQ ID NO:728) also has the following non-silent SNPs (Single Nucleotide Polymorphisms) as listed in Table 203, (given according to their position(s) on the amino acid sequence, with the alternative amino acid(s) listed; the last column indicates whether the SNP is known or not; the presence of known SNPs in variant protein HUMC5_PEA_3_P13 sequence provides support for the deduced sequence of this variant protein according to the present invention).

TABLE 203

| Amino acid mutations | | |
|---|---|---|
| SNP position(s) on amino acid sequence | Alternative amino acid(s) | Previously known SNP? |
| 74 | S → P | No |
| 449 | R → G | Yes |

The glycosylation sites of variant protein HUMC5_PEA_3_P13 (SEQ ID NO:728), as compared to the known protein Complement C5 precursor (SEQ ID NO:730) [Contains: C5a anaphylatoxin], are described in Table 204 (given according to their position(s) on the amino acid sequence in the first column; the second column indicates whether the glycosylation site is present in the variant protein; and the last column indicates whether the position is different on the variant protein).

TABLE 204

| Glycosylation site(s) | | |
|---|---|---|
| Position(s) on known amino acid sequence | Present in variant protein? | Position in variant protein? |
| 1630 | no | |
| 911 | no | |
| 741 | no | |
| 1115 | no | |

The variant protein has the following domains, as determined by using InterPro. The domains are described in Table 205:

TABLE 205

| InterPro domain(s) | | | |
|---|---|---|---|
| InterPro ID | Domain description | Analysis type | Position(s) on protein |
| IPR002890 | Alpha-2-macroglobulin, N-terminal | HMMPfam | 3-505 |

Variant protein HUMC5_PEA_3_P13 (SEQ ID NO:728) is encoded by the following transcript(s): HUMC5_PEA_3_T14 (SEQ ID NO:701). The coding portion of transcript HUMC5_PEA_3_T14 (SEQ ID NO:701) starts at position 32 and ends at position 1546. The transcript also has the following SNPs as listed in Table 206 (given according to their position on the nucleotide sequence, with the alternative nucleic acid listed; the last column indicates whether the SNP is known or not; the presence of known SNPs in variant protein HUMC5_PEA_3_P13 (SEQ ID NO:728) sequence provides support for the deduced sequence of this variant protein according to the present invention).

TABLE 206

| Nucleic acid SNPs | | |
|---|---|---|
| SNP position on nucleotide sequence | Alternative nucleic acid | Previously known SNP? |
| 1 | A → T | No |
| 251 | T → C | No |
| 1186 | A → G | Yes |
| 1376 | A → G | Yes |
| 1492 | C → T | Yes |
| 1513 | C → T | Yes |
| 1653 | G → A | Yes |
| 2021 | C → T | Yes |

Variant protein HUMC5_PEA_3_P15 (SEQ ID NO:729) according to the present invention is encoded by transcript(s) HUMC5_PEA_3_T16 (SEQ ID NO:702). An alignment is given to the known protein (Complement C5 precursor [Contains: C5a anaphylatoxin]) in FIG. 174. A brief description of the relationship of the variant protein according to the present invention to each such aligned protein is as follows:

Comparison report between HUMC5_PEA_3_P15 (SEQ ID NO:729) and CO5_HUMAN (SEQ ID NO:730):

1. An isolated chimeric polypeptide HUMC5_PEA_3_P15 (SEQ ID NO:729), comprising a first amino acid sequence being at least 90% homologous to MGLLGILCFLIFLGKTWGQEQTYVISAP-KIPRVGASENIVIQVYGYTEAFDATIS IKSYPDKKF-SYSSGHVHLSSENKFQNSAILTIQP-KQLPGGQNPVSYVYLEVVSK HFSKSKRMPITYDNGFLFIHTDKPVYTP-DQSVKVRVYSLNDDLKPAKRETVLT FIDPEGSEVDM-VEEIDHIGIISFPDFKIPSNPRYGMW-TIKAKYKEDFSTTGTAYF EVKEYVLPHFSVSIEPEYNFIGYKNFKN-FEITIKARYFYNKVVTEADVYITFGIR EDLKD-DQKEMMQTAMQNTML corresponding to amino acids 1-292 of CO5_HUMAN (SEQ ID NO:730), which also corresponds to amino acids 1-292 of HUMC5_PEA_3_P15 (SEQ ID NO:729), and a second amino acid sequence being at least 70%, optionally at least 80%, preferably at least 85%, more preferably at least 90% and most preferably at least 95% homologous to a polypeptide having the sequence RAEVR corresponding to amino acids 293-297 of HUMC5_PEA_3_P15 (SEQ ID NO:729), wherein said first amino acid sequence and second amino acid sequence are contiguous and in a sequential order.

2. An isolated polypeptide for a tail of HUMC5_PEA_3_P15 (SEQ ID NO:729), comprising a polypeptide being at least 70%, optionally at least about 80%, preferably at least about 85%, more preferably at least about 90% and most preferably at least about 95% homologous to the sequence RAEVR in HUMC5_PEA_3_P15 (SEQ ID NO:729).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMC5_PEA_3_P15 (SEQ ID NO:729) also has the following non-silent SNPs (Single Nucleotide Polymorphisms) as listed in Table 207, (given according to their position(s) on the amino acid sequence, with the alternative amino acid(s) listed; the last column indicates whether the SNP is known or not; the presence of known SNPs in variant protein HUMC5_PEA_3_P15 (SEQ ID NO:729) sequence provides support for the deduced sequence of this variant protein according to the present invention).

TABLE 207

| Amino acid mutations | | |
|---|---|---|
| SNP position(s) on amino acid sequence | Alternative amino acid(s) | Previously known SNP? |
| 74 | S → P | No |

The glycosylation sites of variant protein HUMC5_PEA_3_P15 (SEQ ID NO:729), as compared to the known protein Complement C5 precursor [Contains: C5a anaphylatoxin], are described in Table 208 (given according to their position(s) on the amino acid sequence in the first column; the second column indicates whether the glycosylation site is present in the variant protein; and the last column indicates whether the position is different on the variant protein).

TABLE 208

| Glycosylation site(s) | | |
|---|---|---|
| Position(s) on known amino acid sequence | Present in variant protein? | Position in variant protein? |
| 1630 | no | |
| 911 | no | |
| 741 | no | |
| 1115 | no | |

The variant protein has the following domains, as determined by using InterPro. The domains are described in Table 209:

TABLE 209

InterPro domain(s)

| InterPro ID | Domain description | Analysis type | Position(s) on protein |
|---|---|---|---|
| IPR002890 | Alpha-2-macroglobulin, N-terminal | HMMPfam | 3-297 |

Variant protein HUMC5_PEA_3_P15 (SEQ ID NO:729) is encoded by the following transcript(s): HUMC5_PEA_3_T16 (SEQ ID NO:702). The coding portion of transcript HUMC5_PEA_3_T16 (SEQ ID NO:702) starts at position 32 and ends at position 922. The transcript also has the following SNPs as listed in Table 210 (given according to their position on the nucleotide sequence, with the alternative nucleic acid listed; the last column indicates whether the SNP is known or not; the presence of known SNPs in variant protein HUMC5_PEA_3_P15 (SEQ ID NO:729) sequence provides support for the deduced sequence of this variant protein according to the present invention).

TABLE 210

Nucleic acid SNPs

| SNP position on nucleotide sequence | Alternative nucleic acid | Previously known SNP? |
|---|---|---|
| 1 | A → T | No |
| 251 | T → C | No |

FIG. 189 depicts the variants domain structure in comparison to the known or wild-type (WT) protein.

T11 contains the convertase binding site on the β-chain (and maybe other, not yet known, binding sites), and thus, might interfere with the binding of the convertase with the wild type C5, and might serve as an antagonist.

T16, T14 might compete with C5 on its interaction with C5 convertase, and may thus serve as an antagonist of complement activation.

Example 55

Description for Cluster HUMFVIII

Cluster HUMFVIII features 4 transcript(s) and 30 segment(s) of interest, the names for which are given in Tables 211 and 212, respectively, the sequences themselves are given in SEQ ID NOs: 731-734; 735-764 and 765-768, for transcripts; segments and proteins, respectively. The selected protein variants are given in table 213.

TABLE 211

Transcripts of interest

| Transcript Name | SEQ ID NO: |
|---|---|
| HUMFVIII_PEA_1_T2 | 731 |
| HUMFVIII_PEA_1_T3 | 732 |
| HUMFVIII_PEA_1_T6 | 733 |
| HUMFVIII_PEA_1_T11 | 734 |

TABLE 212

Segments of interest

| Segment Name | SEQ ID NO: |
|---|---|
| HUMFVIII_PEA_1_node_0 | 735 |
| HUMFVIII_PEA_1_node_3 | 736 |
| HUMFVIII_PEA_1_node_6 | 737 |

Structure of C5 and its Variants

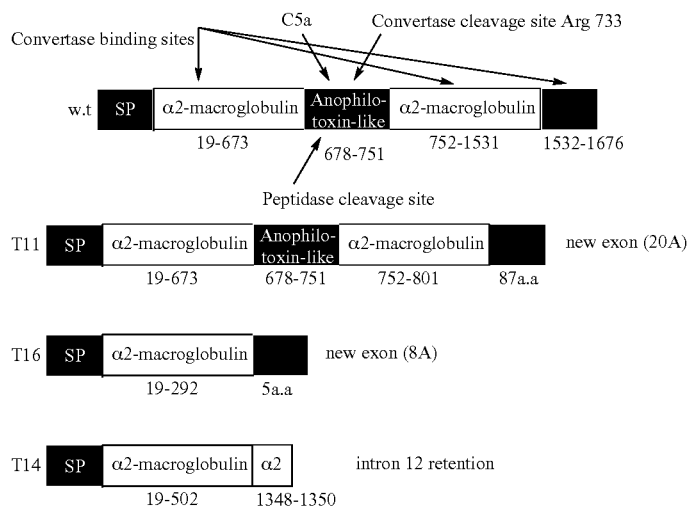

TABLE 212-continued

Segments of interest

| Segment Name | SEQ ID NO: |
|---|---|
| HUMFVIII_PEA_1_node_8 | 738 |
| HUMFVIII_PEA_1_node_10 | 739 |
| HUMFVIII_PEA_1_node_15 | 740 |
| HUMFVIII_PEA_1_node_17 | 741 |
| HUMFVIII_PEA_1_node_19 | 742 |
| HUMFVIII_PEA_1_node_21 | 743 |
| HUMFVIII_PEA_1_node_25 | 744 |
| HUMFVIII_PEA_1_node_27 | 745 |
| HUMFVIII_PEA_1_node_29 | 746 |
| HUMFVIII_PEA_1_node_31 | 747 |
| HUMFVIII_PEA_1_node_33 | 748 |
| HUMFVIII_PEA_1_node_35 | 749 |
| HUMFVIII_PEA_1_node_37 | 750 |
| HUMFVIII_PEA_1_node_39 | 751 |
| HUMFVIII_PEA_1_node_46 | 752 |
| HUMFVIII_PEA_1_node_47 | 753 |
| HUMFVIII_PEA_1_node_49 | 754 |
| HUMFVIII_PEA_1_node_51 | 755 |
| HUMFVIII_PEA_1_node_55 | 756 |
| HUMFVIII_PEA_1_node_4 | 757 |
| HUMFVIII_PEA_1_node_12 | 758 |
| HUMFVIII_PEA_1_node_14 | 759 |
| HUMFVIII_PEA_1_node_23 | 760 |
| HUMFVIII_PEA_1_node_41 | 761 |
| HUMFVIII_PEA_1_node_43 | 762 |
| HUMFVIII_PEA_1_node_52 | 763 |
| HUMFVIII_PEA_1_node_54 | 764 |

TABLE 213

Proteins of interest

| Protein Name | SEQ ID NO: | Protein Length | Corresponding Transcript(s) |
|---|---|---|---|
| HUMFVIII_PEA_1_P9 | 765 | P300 | HUMFVIII_PEA_1_T11 |
| HUMFVIII_PEA_1_P10 | 766 | P2316 | HUMFVIII_PEA_1_T2 |
| HUMFVIII_PEA_1_P11 | 767 | P2345 | HUMFVIII_PEA_1_T3 |
| HUMFVIII_PEA_1_P13 | 768 | P265 | HUMFVIII_PEA_1_T6 |

These sequences are variants of the known protein Coagulation factor VIII precursor (SwissProt accession identifier FA8_HUMAN; SEQ ID NO:769; known also according to the synonyms Procoagulant component; Antihemophilic factor; AHF), referred to herein as the previously known protein.

Protein Coagulation factor VIII precursor is known or believed to have the following function(s): Factor VIII, along with calcium and phospholipid, acts as a cofactor for factor IXa when it converts factor X to the activated form, factor Xa. The sequence for protein Coagulation factor VIII precursor is given in SEQ ID NO: 769, as "Coagulation factor VIII precursor amino acid sequence". Known polymorphisms for this sequence are as shown in Table 214.

TABLE 214

Amino acid mutations for Known Protein

| SNP position(s) on amino acid sequence | Comment |
|---|---|
| 26 | L → R (in HEMA; severe). /FTId = VAR_001045. |
| 30 | E → V (in HEMA; mild). /FTId = VAR_001046. |
| 41 | G → C (in HEMA; severe/moderate). /FTId = VAR_001047. |
| 48 | R → C (in HEMA; severe). /FTId = VAR_001048. |
| 72 | E → K (in HEMA; moderate). /FTId = VAR_017330. |
| 75 | D → V (in dbSNP: 1800288). /FTId = VAR_001049. |
| 89 | G → D (in HEMA; severe). /FTId = VAR_001050. |
| 89 | G → V (in HEMA; mild). /FTId = VAR_001051. |
| 97 | A → P (in HEMA). /FTId = VAR_017331. |
| 99 | V → D (in HEMA; severe). /FTId = VAR_001052. |
| 104 | V → D (in HEMA; mild). /FTId = VAR_001053. |
| 108 | K → T (in HEMA; mild). /FTId = VAR_001054. |
| 110 | M → V (in HEMA; moderate). /FTId = VAR_001055. |
| 117 | L → R (in HEMA; severe). /FTId = VAR_001056. |
| 129 | E → V (in HEMA; severe). /FTId = VAR_001057. |
| 130 | G → R (in HEMA; severe). /FTId = VAR_001058. |
| 132 | E → D (in HEMA; severe). /FTId = VAR_001059. |
| 133 | Y → C (in HEMA; mild). /FTId = VAR_001060. |
| 135 | D → G (in HEMA; severe). /FTId = VAR_001061. |
| 137 | T → I (in HEMA; mild). /FTId = VAR_001062. |
| 155 | Y → H (in HEMA; moderate). /FTId = VAR_017332. |
| 164 | G → V (in HEMA; mild). /FTId = VAR_001063. |
| 165 | P → S (in HEMA; severe). /FTId = VAR_001064. |
| 181 | V → M (in HEMA; moderate). /FTId = VAR_001065. |
| 181 | V → E (in HEMA; mild). /FTId = VAR_017333. |
| 185 | K → T (in HEMA; mild). /FTId = VAR_001066. |
| 189 | S → L (in HEMA; moderate). /FTId = VAR_001067. |
| 202 | S → R (in HEMA; mild). /FTId = VAR_008123. |
| 222 | D → V (in HEMA; moderate). /FTId = VAR_001068. |
| 224 | G → W (in HEMA; moderate). /FTId = VAR_001069. |
| 253 | V → F (in HEMA; severe). /FTId = VAR_001070. |
| 254 | N → I (in HEMA; severe). /FTId = VAR_017334. |

TABLE 214-continued

Amino acid mutations for Known Protein

| SNP position(s) on amino acid sequence | Comment |
|---|---|
| 255 | G → V (in HEMA; severe). /FTId = VAR_015127. |
| 266 | G → E (in HEMA; severe). /FTId = VAR_001071. |
| 278 | G → R (in HEMA; severe). /FTId = VAR_001072. |
| 285 | V → G (in HEMA; mild). /FTId = VAR_001073. |
| 291 | E → G (in HEMA; mild). /FTId = VAR_001074. |
| 294 | T → I (in HEMA; moderate). /FTId = VAR_001075. |
| 299 | N → I (in HEMA; mild). /FTId = VAR_001076. |
| 301 | R → H (in HEMA; severe). /FTId = VAR_001077. |
| 301 | R → L (in HEMA; severe). /FTId = VAR_001078. |
| 308 | S → L (in HEMA; moderate). /FTId = VAR_001079. |
| 312 | F → S (in HEMA; moderate). /FTId = VAR_001080. |
| 314 | T → A (in HEMA; mild). /FTId = VAR_001081. |
| 314 | T → I (in HEMA; moderate). /FTId = VAR_001082. |
| 323 | G → E (in HEMA; severe). /FTId = VAR_015128. |
| 327 | L → P (in HEMA; severe). /FTId = VAR_001083. |
| 331 | I → V (in HEMA; mild). /FTId = VAR_001084. |
| 345 | V → L (in HEMA; severe). /FTId = VAR_001085. |
| 348 | C → R (in HEMA; severe). /FTId = VAR_001086. |
| 348 | C → S (in HEMA; moderate). /FTId = VAR_001087. |
| 348 | C → Y (in HEMA; severe). /FTId = VAR_001088. |
| 391 | R → C (in HEMA; Okayama; moderate; abolishes the normal cleavage by thrombin). /FTId = VAR_001089. |
| 391 | R → H (in HEMA; Kumamoto; moderate; abolishes the normal cleavage by thrombin). /FTId = VAR_001090. |
| 391 | R → P (in HEMA; severe; abolishes the normal cleavage by thrombin). /FTId = VAR_001091. |
| 392 | S → L (in HEMA; mild; abolishes normal cleavage by thrombin). /FTId = VAR_001092. |
| 392 | S → P (in HEMA; mild). /FTId = VAR_001093. |
| 405 | I → S (in HEMA; severe). /FTId = VAR_001094. |
| 409 | E → G (in HEMA; severe/moderate). /FTId = VAR_001095. |
| 431 | L → F (in HEMA; moderate). /FTId = VAR_001096. |
| 439 | G → V (in HEMA; severe). /FTId = VAR_001097. |
| 439 | G → S (in HEMA; moderate). /FTId = VAR_017335. |
| 444 | K → R (in HEMA; severe). /FTId = VAR_001098. |
| 450 | Y → N (in HEMA; moderate). /FTId = VAR_001099. |
| 474 | G → R (in HEMA; severe). /FTId = VAR_001100. |
| 488 | A → G (in HEMA; moderate). /FTId = VAR_001101. |
| 492 | Y → H (in HEMA; mild). /FTId = VAR_001102. |
| 492 | Y → C (in HEMA; moderate). /FTId = VAR_001103. |
| 494 | I → T (in HEMA; mild). /FTId = VAR_001104. |
| 498 | G → R (in HEMA; severe/moderate). /FTId = VAR_001105. |
| 529 | K → E (in HEMA; moderate). /FTId = VAR_017336. |
| 544 | D → N (in HEMA; moderate). /FTId = VAR_001106. |
| 546 | R → W (in HEMA; mild). /FTId = VAR_001107. |
| 550 | R → C (in HEMA; moderate). /FTId = VAR_001108. |
| 550 | R → G (in HEMA; mild). /FTId = VAR_001109. |
| 550 | R → H (in HEMA; mild). /FTId = VAR_001110. |
| 554 | S → G (in HEMA; mild). /FTId = VAR_001111. |
| 556 | V → D (in HEMA; moderate). /FTId = VAR_001112. |
| 561 | D → Y (in HEMA; severe). /FTId = VAR_008967. |
| 567 | I → T (in HEMA; mild). /FTId = VAR_017337. |
| 577 | S → F (in HEMA; mild). /FTId = VAR_001113. |
| 584 | Q → K (in HEMA; moderate). /FTId = VAR_001114. |
| 585 | I → T (in HEMA; severe/moderate). /FTId = VAR_001115. |
| 586 | M → V (in HEMA; mild). /FTId = VAR_015129. |
| 596 | S → P (in HEMA; severe). /FTId = VAR_001116. |
| 603 | S → I (in HEMA). /FTId = VAR_001117. |
| 604 | W → C (in HEMA; severe). /FTId = VAR_001118. |
| 605 | Y → S (in HEMA; severe). /FTId = VAR_001119. |
| 612 | R → C (in HEMA; moderate). /FTId = VAR_001120. |
| 631 | N → K (in HEMA; severe). /FTId = VAR_001121. |
| 631 | N → S (in HEMA). /FTId = VAR_001122. |
| 644 | L → V (in HEMA; mild). /FTId = VAR_001123. |
| 653 | V → A (in HEMA; mild). /FTId = VAR_001124. |
| 653 | V → M (in HEMA; severe). /FTId = VAR_001125. |
| 663 | A → V (in HEMA; mild). /FTId = VAR_001126. |
| 671 | Missing (in HEMA; severe). /FTId = VAR_001127. |
| 677 | F → L (in HEMA; moderate). /FTId = VAR_001128. |
| 699 | M → V (in HEMA; severe). /FTId = VAR_001129. |
| 717 | R → W (in HEMA; mild). /FTId = VAR_001130. |
| 720 | G → D (in HEMA; severe/moderate). /FTId = VAR_001131. |
| 723 | A → T (in HEMA; moderate). /FTId = VAR_001132. |
| 727 | V → F (in HEMA; severe). /FTId = VAR_001133. |
| 739 | E → K (in HEMA; mild). /FTId = VAR_001134. |
| 1057 | E → K (in HEMA; moderate). /FTId = VAR_001135. |
| 1260 | D → E (in dbSNP: 1800291). /FTId = VAR_001136. |
| 1481 | L → P (in dbSNP: 1800294). /FTId = VAR_001137. |
| 1699 | Y → C (in HEMA; severe). /FTId = VAR_001138. |
| 1699 | Y → F (in HEMA; moderate). /FTId = VAR_001139. |
| 1708 | R → C (in HEMA; East Hartford; severe/moderate; abolishes thrombin cleavage at the light chain). /FTId = VAR_001140. |
| 1708 | R → H (in HEMA; mild; abolishes thrombin cleavage at the light chain). /FTId = VAR_001141. |
| 1715 | R → G (in HEMA; mild). /FTId = VAR_001142. |
| 1723 | E → K (in HEMA; severe). /FTId = VAR_001143. |
| 1728 | Y → C (in HEMA; moderate). /FTId = VAR_001144. |
| 1769 | G → R (in HEMA; mild). /FTId = VAR_001145. |
| 1775 | L → V (in HEMA; moderate). /FTId = VAR_001146. |
| 1775 | L → F (in HEMA; mild). /FTId = VAR_001147. |
| 1779 | G → E (in HEMA; severe). /FTId = VAR_001148. |
| 1791 | M → T (in HEMA; severe). /FTId = VAR_001149. |
| 1800 | R → H (in HEMA; moderate). /FTId = VAR_001150. |
| 1800 | R → C (in HEMA; moderate). /FTId = VAR_001151. |
| 1800 | R → G (in HEMA; mild). /FTId = VAR_001152. |
| 1803 | S → Y (in HEMA; severe). /FTId = VAR_001153. |
| 1804 | F → S (in HEMA; severe). /FTId = VAR_017338. |
| 1808 | L → F (in HEMA; mild). /FTId = VAR_001154. |
| 1842 | M → I (in HEMA; moderate). /FTId = VAR_001155. |
| 1844 | P → S (in HEMA; mild). /FTId = VAR_001156. |
| 1845 | T → P (in HEMA; mild). /FTId = VAR_001157. |
| 1853 | A → T (in HEMA; severe). /FTId = VAR_001158. |
| 1853 | A → V (in HEMA; mild). /FTId = VAR_001159. |
| 1865 | D → N (in HEMA; severe). /FTId = VAR_001160. |
| 1865 | D → Y (in HEMA; severe). /FTId = VAR_001161. |
| 1867 | H → R (in HEMA; moderate). /FTId = VAR_001162. |
| 1869 | G → V (in HEMA; severe). /FTId = VAR_001163. |
| 1873 | P → R (in HEMA; severe). /FTId = VAR_001164. |
| 1888 | R → I (in HEMA; severe). /FTId = VAR_001165. |
| 1894 | E → G (in HEMA; moderate). /FTId = VAR_001166. |
| 1904 | E → K (in HEMA; severe). /FTId = VAR_001167. |
| 1941 | N → D (in HEMA; severe/moderate). /FTId = VAR_001168. |
| 1941 | N → S (in HEMA; severe/moderate). /FTId = VAR_001169. |
| 1942 | G → A (in HEMA; moderate). /FTId = VAR_015130. |
| 1960 | R → Q (in HEMA; moderate). /FTId = VAR_001170. |
| 1960 | R → L (in HEMA; moderate). /FTId = VAR_001171. |
| 1963 | L → P (in HEMA; severe). /FTId = VAR_015131. |
| 1967 | G → D (in HEMA; moderate). /FTId = VAR_001172. |
| 1979 | G → V (in HEMA; moderate). /FTId = VAR_001173. |
| 1980 | H → Y (in HEMA; mild). /FTId = VAR_001174. |
| 2016 | R → W (in HEMA; severe/moderate). /FTId = VAR_001175. |
| 2036 | Y → C (in HEMA; moderate). /FTId = VAR_015132. |
| 2038 | N → S (in HEMA; moderate). /FTId = VAR_001176. |
| 2051 | I → S (in HEMA; severe). /FTId = VAR_017339. |
| 2065 | W → R (in HEMA; moderate). /FTId = VAR_001177. |
| 2088 | S → F (in HEMA; severe). /FTId = VAR_001178. |
| 2093 | D → G (in HEMA; mild). /FTId = VAR_001179. |
| 2105 | T → N (in HEMA; severe). /FTId = VAR_001180. |
| 2107 | G → S (in HEMA; severe). /FTId = VAR_001181. |
| 2120 | F → L (in HEMA; mild). /FTId = VAR_001182. |
| 2124 | Y → C (in HEMA; mild). /FTId = VAR_001183. |
| 2135 | R → P (in HEMA; severe). /FTId = VAR_001184. |
| 2138 | S → Y (in HEMA; severe). /FTId = VAR_001185. |
| 2141 | T → N (in HEMA; severe). /FTId = VAR_017340. |
| 2148 | N → S (in HEMA; moderate). /FTId = VAR_001186. |
| 2169 | R → H (in HEMA; severe/mild). /FTId = VAR_001187. |
| 2172 | P → Q (in HEMA; moderate). /FTId = VAR_001188. |
| 2172 | P → R (in HEMA; severe). /FTId = VAR_015133. |
| 2173 | T → I (in HEMA; mild). /FTId = VAR_001189. |

TABLE 214-continued

Amino acid mutations for Known Protein

| SNP position(s) on amino acid sequence | Comment |
|---|---|
| 2178 | R → C (in HEMA; mild). /FTId = VAR_001190. |
| 2178 | R → H (in HEMA; mild). /FTId = VAR_001191. |
| 2178 | R → L (in HEMA; mild). /FTId = VAR_001192. |
| 2182 | R → C (in HEMA; severe/moderate). /FTId = VAR_001193. |
| 2182 | R → H (in HEMA; severe/moderate). /FTId = VAR_001194. |
| 2183 | M → V (in HEMA; mild). /FTId = VAR_001195. |
| 2185 | L → S (in HEMA; severe). /FTId = VAR_001196. |
| 2193 | C → G (in HEMA). /FTId = VAR_017341. |
| 2204 | I → T (in HEMA; mild). /FTId = VAR_001197. |
| 2209 | I → N (in HEMA; moderate). /FTId = VAR_001198. |
| 2211 | A → P (in HEMA; moderate). /FTId = VAR_001199. |
| 2223 | Missing (in HEMA; severe/moderate). /FTId = VAR_001200. |
| 2228 | R → G (in HEMA; severe). /FTId = VAR_001201. |
| 2228 | R → L (in HEMA; moderate). /FTId = VAR_001202. |
| 2228 | R → Q (in HEMA; severe/moderate). /FTId = VAR_001203. |
| 2242 | V → M. /FTId = VAR_001204. |
| 2248 | W → C (in HEMA; moderate). /FTId = VAR_001205. |
| 2262 | V → VQ (in HEMA; moderate). /FTId = VAR_017342. |
| 2265 | Q → R (in HEMA; moderate). /FTId = VAR_001206. |
| 2307 | D → A (in HEMA; moderate). /FTId = VAR_015134. |
| 2319 | P → L (in HEMA; mild/severe). /FTId = VAR_001207. |
| 2319 | P → S (in HEMA; mild). /FTId = VAR_001208. |
| 2323 | R → C (in HEMA; severe; may cause reduced phospholipid binding). /FTId = VAR_001209. |
| 2323 | R → H (in HEMA; mild; may cause reduced phospholipid binding). /FTId = VAR_001210. |
| 2326 | R → L (in HEMA; severe/moderate; may cause reduced phospholipid binding). /FTId = VAR_001211. |
| 2326 | R → Q (in HEMA; moderate; may cause reduced phospholipid binding). /FTId = VAR_001212. |
| 2344 | G → C (in HEMA; moderate). /FTId = VAR_008968. |
| 768 | P → R |
| 1922 | C → S |

Protein Coagulation factor VIII precursor localization is believed to be Extracellular.

The previously known protein also has the following indication(s) and/or potential therapeutic use(s): Haemophilia A; Haemophilia. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Factor VIII agonist; Factor VIIIc agonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Haemostatic; Blood fraction; Antifibrinolytic.

The following GO Annotation(s) apply to the previously known protein. The following annotation(s) were found: acute-phase response; cell adhesion; blood coagulation, which are annotation(s) related to Biological Process; and blood coagulation factor; copper binding, which are annotation(s) related to Molecular Function.

The GO assignment relies on information from one or more of the SwissProt/TremB1 Protein knowledgebase, or Locuslink.

Factor VIII (F8) is a cofactor for F9a (intrinsic pathway). Along with calcium and phospholipid, it acts as a cofactor for factor IXa when it converts factor X to the activated form, factor Xa. Factor VIII becomes activated by Thrombin (F2) which cleaves its activation peptide. Defects in F8 cause hemophilia A: Incidence=1-2 in 10,000 males.

FIGS. 190, 191, 192 depict, Factor VIII launched products, related development and clinical preclinical developments, respectively.

As noted above, cluster HUMFVIII features 4 transcript(s), which were listed in Table 211 above. These transcript(s) encode for protein(s) which are variant(s) of protein Coagulation factor VIII precursor. A description of each variant protein according to the present invention is now provided.

Variant protein HUMFVIII_PEA_1_P9 according to the present invention is encoded by transcript(s) HUMFVIII_PEA_1_T11. An alignment is given to the known protein (Coagulation factor VIII precursor) in FIG. 175. A brief description of the relationship of the variant protein according to the present invention to each such aligned protein is as follows:

Comparison report between HUMFVIII_PEA_1_P9 and FA8_HUMAN:

1. An isolated chimeric polypeptide HUMFVIII_PEA_1_P9, comprising a first amino acid sequence being at least 90% homologous to MQIELSTCFFLCLLRFCFSATR-RYYLGAVELSWDYMQSDLGELPVDARFPPRV PKSF-PFNTSVVYKKTLFVEFTDHLFNIAKPRP-PWMGLLGPTIQAEVYDTVVITL KNMASHPVSLHAVGVSYWKASEGAEYD-DQTSQREKEDDKVFPGGSHTYVW QVLKENGPMAS-DPLCLTYSYLSHVDLVKDLNSGLI-GALLVCREGSLAKEKTQ TLHKFILLFAVFDEGKSWHSETKNSLM-QDRDAASARAWPKMHTVNGYVNRS LPG corresponding to amino acids 1-263 of FA8_HUMAN, which also corresponds to amino acids 1-263 of HUMFVIII_PEA_1_P9, and a second amino acid sequence being at least 70%, optionally at least 80%, preferably at least 85%, more preferably at least 90% and most preferably at least 95% homologous to a polypeptide having the sequence MYTPAQQSSGSSKF-STRVLYFSSQTARHLRGYSPLNT corresponding to amino acids 264-300 of HUMFVIII_PEA_1_P9, wherein said first amino acid sequence and second amino acid sequence are contiguous and in a sequential order.

2. An isolated polypeptide for a tail of HUMFVIII_PEA_1_P9, comprising a polypeptide being at least 70%, optionally at least about 80%, preferably at least about 85%, more preferably at least about 90% and most preferably at least about 95% homologous to the sequence MYT-PAQQSSGSSKFSTRVLYFSSQTARHLRGYSPLNT in HUMFVIII_PEA_1_P9.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMFVIII_PEA_1_P9 also has the following non-silent SNPs (Single Nucleotide Polymorphisms) as listed in Table 215, (given according to their position(s) on the amino acid sequence, with the alternative amino acid(s) listed; the last column indicates whether the SNP is known or not; the presence of known SNPs in variant protein HUM- FVIII_PEA_1_P9 sequence provides support for the deduced sequence of this variant protein according to the present invention).

TABLE 215

Amino acid mutations

| SNP position(s) on amino acid sequence | Alternative amino acid(s) | Previously known SNP? |
|---|---|---|
| 75 | D → V | Yes |
| 210 | T → P | Yes |

Variant protein HUMFVIII_PEA_1_P9 is encoded by the following transcript(s): HUMFVIII_PEA_1_T11. The coding portion of transcript HUMFVIII_PEA_1_T11 starts at position 173 and ends at position 1072. The transcript also has the following SNPs as listed in Table 216 (given according to their position on the nucleotide sequence, with the alternative nucleic acid listed; the last column indicates whether the SNP is known or not; the presence of known SNPs in variant protein HUMFVIII_PEA_1_P9 sequence provides support for the deduced sequence of this variant protein according to the present invention).

TABLE 216

Nucleic acid SNPs

| SNP position on nucleotide sequence | Alternative nucleic acid | Previously known SNP? |
|---|---|---|
| 274 | C → T | Yes |
| 396 | A → T | Yes |
| 800 | A → C | Yes |

Variant protein HUMFVIII_PEA_1_P10 according to the present invention is encoded by transcript(s) HUMFVIII_PEA_1_T2. An alignment is given to the known protein (Coagulation factor VIII precursor) in FIG. 176. A brief description of the relationship of the variant protein according to the present invention to each such aligned protein is as follows:

Comparison Report Between HUMFVIII_PEA_1_P10 and FA8_HUMAN:

1. An isolated chimeric polypeptide HUMFVIII_PEA_1_P10, comprising a first amino acid sequence being at least 70%, optionally at least 80%, preferably at least 85%, more preferably at least 90% and most preferably at least 95% homologous to a polypeptide having the sequence MHRDARAQKASRG corresponding to amino acids 1-13 of HUMFVIII_PEA_1_P10, and a second amino acid sequence being at least 90% homologous to FPPRVPKSFPFNTSVVYKKTLFVEFTDHLFNIAKPRPPWMGLLGPTIQAEVYDT VVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLA KEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEIS PITFLTAQTLLMDLGQFLLFCHISSHQHDGMEAYVKVDSCPEEPQLRMKNNE EAEDYDDDLTDSEMDVVRFDDDNSPSFIQIRSVAKKHPKTWVHYIAAEEEDW DYAPLVLAPDDRSYKSQYLNNGPQRIGRKYKKVRFMAYTDETFKTREAIQHE SGILGPLLYGEVGDTLLIIFKNQASRPYNIYPHGITDVRPLYSRRLPKGVKHLK DFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDP EFQASNIMHSINGYVFDSLQLSVCLHEVAYWYILSIGAQTDFLSVFFSGYTFKH KMVYEDTLTLFPFSGETVFNISMENPGLWILGCHNSDFRNRGMTALLKVSSCD KNTGDYYEDSYEDISAYLLSKNNAIEPRSFSQNSRHPSTRQKQFNATTIPENDI EKTDPWFAHRTPMPKIQNVSSSDLLMLLRQSPTPHGLSLSDLQEAKYETFSDD PSPGAIDSNNSLSEMTHFRPQLHHSGDMVFTPESGLQLRLNEKLGTTAATELK KLDFKVSSTSNNLISTIPSDNLAAGTDNTSSLGPPSMPVHYDSQLDTTLFGKKS SPLTESGGPLSLSEENNDSKLLESGLMNSQESSWGKNVSSTESGRLFKGKRAH GPALLTKDNALFKVSISLLKTNKTSNNSATNRKTHIDGPSLLIENSPSVWQNIL ESDTEFKKVTPLIHDRMLMDKNATALRLNHMSNKTTSSKNMEMVQQKKEGP IPPDAQNPDMSFFKMLFLPESARWIQRTHGKNSLNSGQGPSPKQLVSLGPEKS VEGQNFLSEKNKVVVGKGEFTKDVGLKEMVFPSSRNLFLTNLDNLHENNTH NQEKKIQEEIEKKETLIQENVVLPQIHTVTGTKNFMKNLFLLSTRQNVEGSYD GAYAPVLQDFRSLNDSTNRTKKHTAHFSKKGEEENLEGLGNQTKQIVEKYAC TTRISPNTSQQNFVTQRSKRALKQFRLPLEETELEKRIIVDDTSTQWSKNMKH LTPSTLTQIDYNEKEKGAITQSPLSDCLTRSHSIPQANRSPLPIAKVSSFPSIRPIY LTRVLFQDNSSHLPAASYRKKDSGVQESSHFLQGAKKNNLSLAILTLEMTGD QREVGSLGTSATNSVTYKKVENTVLPKPDLPKTSGKVELLPKVHIYQKDLFPT ETSNGSPGHLDLVEGSLLQGTEGAIKWNEANRPGKVPFLRVATESSAKTPSKL LDPLAWDNHYGTQIPKEEWKSQEKSPEKTAFKKKDTILSLNACESNHAIAAIN EGQNKPEIEVTWAKQGRTERLCSQNPPVLKRHQREITRTTLQSDQEEIDYDDT ISVEMKKEDFDIYDEDENQSPRSFQKKTRHYFIAAVERLWDYGMSSSPHVLR NRAQSGSVPQFKKVVFQEFTDGSFTQPLYRGELNEHLGLLGPYIRAEVEDNIM VTFRNQASRPYSFYSSLISYEEDQRQGAEPRKNFVKPNETKTYFWKVQHHMA PTKDEFDCKAWAYFSDVDLEKDVHSGLIGPLLVCHTNTLNPAHGRQVTVQEF ALFFTIFDETKSWYFTENMERNCRAPCNIQMEDPTFKENYRFHAINGYIMDTL PGLVMAQDQRIRWYLLSMGSNENIHSIHFSGHVFTVRKKEEYKMALYNLYPG VFETVEMLPSKAGIWRVECLIGEHLHAGMSTLFLVYSNKCQTPLGMASGHIR DFQITASGQYGQWAPKLARLHYSGSINAWSTKEPFSWIKVDLLAPMIIHGIKT QGARQKFSSLYISQFIIMYSLDGKKWQTYRGNSTGTLMVFFGNVDSSGIKHNI FNPPIIARYIRLHPTHYSIRSTLRMELMGCDLNSCSMPLGMESKAISDAQITASS YFTNMFATWSPSKARLHLQGRSNAWRPQVNNPKEWLQVDFQKTMKVTGVT TQGVKSLLTSMYVKEFLISSSQDGHQWTLFFQNGKVKVFQGNQDSFTPVVNS LDPPLLTRYLRIHPQSWVHQIALRMEVLGCEAQDLY corresponding to amino acids 49-2351 of FA8_HUMAN, which also corresponds to amino acids 14-2316 of HUM- FVIII_PEA_1_P10, wherein said first amino acid sequence and second amino acid sequence are contiguous and in a sequential order.

2. An isolated polypeptide for a head of HUMFVII-I_PEA_1_P10, comprising a polypeptide being at least 70%, optionally at least about 80%, preferably at least about 85%, more preferably at least about 90% and most preferably at least about 95% homologous to the sequence MHRD-ARAQKASRG of HUMFVIII_PEA_1_P10.

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein HUMFVIII_PEA_1_P10 also has the following non-silent SNPs (Single Nucleotide Polymorphisms) as listed in Table 217, (given according to their position(s) on the amino acid sequence, with the alternative amino acid(s) listed; the last column indicates whether the SNP is known or not; the presence of known SNPs in variant protein HUMFVIII_PEA_1_P10 sequence provides support for the deduced sequence of this variant protein according to the present invention).

TABLE 217

Amino acid mutations

| SNP position(s) on amino acid sequence | Alternative amino acid(s) | Previously known SNP? |
|---|---|---|
| 40 | D → V | Yes |
| 175 | T → P | Yes |
| 760 | R → G | Yes |
| 1225 | D → E | Yes |
| 1446 | L → P | Yes |
| 1887 | C → S | Yes |
| 1887 | C → W | Yes |
| 2199 | R → G | No |
| 2199 | R → W | No |
| 2222 | M → V | Yes |
| 2240 | Y → C | No |

The variant protein has the following domains, as determined by using InterPro. The domains are described in Table 218:

TABLE 218

InterPro domain(s)

| InterPro ID | Domain description | Analysis type | Position(s) on protein |
|---|---|---|---|
| IPR001117 | Multicopper oxidase, type 1 | HMMPfam | 183-314 |
| IPR000421 | Coagulation factor 5/8 type C domain (FA58C) | HMMPfam | 2008-2150, 2161-2307 |
| IPR000421 | Coagulation factor 5/8 type C domain (FA58C) | HMMSmart | 2004-2153, 2157-2310 |
| IPR001117 | Multicopper oxidase, type 1 | ScanRegExp | 1978-1998, 288-308, 670-690 |
| IPR000421 | Coagulation factor 5/8 type C domain (FA58C) | ScanRegExp | 2045-2072, 2202-2231 |
| IPR000421 | Coagulation factor 5/8 type C domain (FA58C) | ScanRegExp | 2137-2153, 2294-2310 |
| IPR000421 | Coagulation factor 5/8 type C domain (FA58C) | ProfileScan | 2005-2153, 2158-2310 |

Variant protein HUMFVIII_PEA_1_P10 is encoded by the following transcript(s): HUMFVIII_PEA_1_T2. The coding portion of transcript HUMFIII_PEA_1_T2 starts at position 124 and ends at position 7071. The transcript also has the following SNPs as listed in Table 219 (given according to their position on the nucleotide sequence, with the alternative nucleic acid listed; the last column indicates whether the SNP is known or not; the presence of known SNPs in variant protein HUMFVIII_PEA_1_P10 sequence provides support for the deduced sequence of this variant protein according to the present invention).

TABLE 219

Nucleic acid SNPs

| SNP position on nucleotide sequence | Alternative nucleic acid | Previously known SNP? |
|---|---|---|
| 242 | A → T | Yes |
| 646 | A → C | Yes |
| 1104 | G → A | Yes |
| 1884 | T → C | Yes |
| 2401 | A → G | Yes |
| 3798 | C → G | Yes |
| 3882 | A → C | Yes |
| 3939 | A → C | Yes |
| 4460 | T → C | Yes |
| 4539 | A → C | Yes |
| 5310 | G → A | Yes |
| 5783 | G → C | Yes |
| 5784 | C → G | Yes |
| 6660 | C → T | Yes |
| 6718 | A → G | No |
| 6718 | A → T | No |
| 6787 | A → G | Yes |
| 6842 | A → G | No |
| 7103 | C → T | Yes |
| 7776 | T → | Yes |
| 8259 | C → T | Yes |
| 8366 | G → A | Yes |
| 8602 | C → A | Yes |
| 8746 | A → G | Yes |

Variant protein HUMFVIII_PEA_1_P11 according to the present invention is encoded by transcript(s) HUMFVII-I_PEA_1_T3. An alignment is given to the known protein (Coagulation factor VIII precursor) in FIG. 177. A brief description of the relationship of the variant protein according to the present invention to each such aligned protein is as follows:

Comparison Report Between HUMFVIII_PEA_1_µl and FA8_HUMAN:

1. An isolated chimeric polypeptide HUMFVIII_PEA_1_P11, comprising a first amino acid sequence being at least 70%, optionally at least 80%, preferably at least 85%, more preferably at least 90% and most preferably at least 95% homologous to a polypeptide having the sequence MHRDARAQKASRG corresponding to amino acids 1-13 of HUMFVIII_PEA_1_P11, and a second amino acid sequence being at least 90% homologous to ATRRYYLGAVELSWDYMQSDLGELPVDARFPPRVPKSFPFNTSVVYKKTLFV EFTDHLFNIAKPRPPWMGLLGPTIQAEVYDTVVITLKNMASHPVSLHAVGVS YWKASEGAEYDDQTSQREKEDDKVFPGGSHTYVWQVLKENGPMASDPLCL TYSYLSHVDLVKDLNSGLIGALLVCREGSLAKEKTQTLHKFILLFAVFDEGKS WHSETKNSLMQDRDAASARAWPKMHTVNGYVNRSLPGLIGCHRKSVYWHV IGMGTTPEVHSIFLEGHTFLVRNHRQASLEISPITFLTAQTLLMDLGQFLLFCHI SSHQHDGMEAYVKVDSCPEEPQLRMKNNEEAEDYDDDLTDSEMDVVRFDD DNSPSFIQIRSVAKKHPKTWVHYIAAEEEDWDYAPLVLAPDDRSYKSQYLNN GPQRIGRKYKKVRFMAYTDETFKTREAIQHESGILGPLLYGEVGDTLLIIFKNQ ASRPYNIYPHGITDVRPLYSRRLPKGVKHLKDFPILPGEIFKYKWTVTVEDGPT KSDPRCLTRYYSSFVNMERDLASGLIGPLLICYKESVDQRGNQIMSDKRNVIL FSVFDENRSWYLTENIQRFLPNPAGVQLEDPEFQASNIMHSINGYVFDSLQLS VCLHEVAYWYILSIGAQTDFLSVFFSGYTFKHKMVYEDTLTLFPFSGETVFMS MENPGLWILGCHNSDFRNRGMTALLKVSSCDKNTGDYYEDSYEDISAYLLSK NNAIEPRSFSQNSRHPSTRQKQFNATTIPENDIEKTDPWFAHRTPMPKIQNVSS SDLLMLLRQSPTPHGLSLSDLQEAKYETFSDDPSPGAIDSNNSLSEMTHFRPQL HHSGDMVFTPESGLQLRLNEKLGTTAATELKKLDFKVSSTSNNLISTIPSDNLA AGTDNTSSLGPPSMPVHYDSQLDTTLFGKKSSPLTESGGPLSLSEENNDSKLLE SGLMNSQESSWGKNVSSTESGRLFKGKRAHGPALLTKDNALFKVSISLLKTN KTSNNSATNRKTHIDGPSLLIENSPSVWQNILESDTEFKKVTPLIHDRMLMDK NATALRLNHMSNKTTSSKNMEMVQQKKEGPIPPDAQNPDMSFFKMLFLPES ARWIQRTHGKNSLNSGQGPSPKQLVSLGPEKSVEGQNFLSEKNKVVVGKGEF TKDVGLKEMVFPSSRNLFLTNLDNLHENNTHNQEKKIQEEIEKKETLIQENVV LPQIHTVTGTKNFMKNLFLLSTRQNVEGSYDGAYAPVLQDFRSLNDSTNRTK KHTAHFSKKGEEENLEGLGNQTKQIVEKYACTTRISPNTSQQNFVTQRSKRAL KQFRLPLEETELEKRIIVDDTSTQWSKNMKHLTPSTLTQIDYNEKEKGAITQSP LSDCLTRSHSIPQANRSPLPIAKVSSFPSIRPIYLTRVLFQDNSSHLPAASYRKK DSGVQESSHFLQGAKKNNLSLAILTLEMTGDQREVGSLGTSATNSVTYKKVE NTVLPKPDLPKTSGKVELLPKVHIYQKDLFPTETSNGSPGHLDLVEGSLLQGT EGAIKWNEANRPGKVPFLRVATESSAKTPSKLLDPLAWDNHYGTQIPKEEWK SQEKSPEKTAFKKKDTILSLNACESNHAIAAINEGQNKPEIEVTWAKQGRTER LCSQNPPVLKRHQREITRTTLQSDQEEIDYDDTISVEMKKEDFDIYDEDENQSP RSFQKKTRHYFIAAVERLWDYGMSSSPHVLRNRAQSGSVPQFKKVVFQEFTD GSFTQPLYRGELNEHLGLLGPYIRAEVEDNIMVTFRNQASRPYSFYSSLISYEE DQRQGAEPRKNFVKPNETKTYFWKVQHHMAPTKDEFDCKAWAYFSDVDLE KDVHSGLIGPLLVCHTNTLNPAHGRQVTVQEFALFFTIFDETKSWYFTENMER NCRAPCNIQMEDPTFKENYRFHAINGYIMDTLPGLVMAQDQRIRWYLLSMGS NENIHSIHFSGHVFTVRKKEEYKMALYNLYPGVFETVEMLPSKAGIWRVECLI GEHLHAGMSTLFLVYSNKCQTPLGMASGHIRDFQITASGQYGQWAPKLARL HYSGSINAWSTKEPFSWIKVDLLAPMIIHGIKTQGARQKFSSLYISQFIIMYSLD GKKWQTYRGNSTGTLMVFFGNVDSSGIKHNIFNPPIIARYIRLHPTHYSIRSTL RMELMGCDLNSCSMPLGMESKAISDAQITASSYFTNMFATWSPSKARLHLQG RSNAWRPQVNNPKEWLQVDFQKTMKVTGVTTQGVKSLLTSMYVKEFLISSS QDGHQWTLFFQNGKVKVFQGNQDSFTPVVNSLDPPLLTRYLRIHPQSWVHQI ALRMEVLGCEAQDLY corresponding to amino acids 20-2351 of FA8_HUMAN, which also corresponds to amino acids 14-2345 of HUMFVIII_PEA_1_P11, wherein said first amino acid sequence and second amino acid sequence are contiguous and in a sequential order.

2. An isolated polypeptide for a head of HUMFVIII_PEA_1_P11, comprising a polypeptide being at least 70%, optionally at least about 80%, preferably at least about 85%, more preferably at least about 90% and most preferably at least about 95% homologous to the sequence MHRDARAQKASRG of HUMFVIII_PEA_1_P11.

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein HUMFVIII_PEA_1_P11 also has the following non-silent SNPs (Single Nucleotide Polymorphisms) as listed in Table 210, (given according to their position(s) on the amino acid sequence, with the alternative amino acid(s) listed; the last column indicates whether the SNP is known or not; the presence of known SNPs in variant protein HUMFVIII_PEA_1_P11 sequence provides support for the deduced sequence of this variant protein according to the present invention).

TABLE 210

Amino acid mutations

| SNP position(s) on amino acid sequence | Alternative amino acid(s) | Previously known SNP? |
|---|---|---|
| 69 | D → V | Yes |
| 204 | T → P | Yes |
| 789 | R → G | Yes |
| 1254 | D → E | Yes |
| 1475 | L → P | Yes |
| 1916 | C → S | Yes |
| 1916 | C → W | Yes |
| 2228 | R → G | No |
| 2228 | R → W | No |
| 2251 | M → V | Yes |
| 2269 | Y → C | No |

The variant protein has the following domains, as determined by using InterPro. The domains are described in Table 211:

TABLE 211

InterPro domain(s)

| InterPro ID | Domain description | Analysis type | Position(s) on protein |
|---|---|---|---|
| IPR001117 | Multicopper oxidase, type 1 | HMMPfam | 212-343 |
| IPR000421 | Coagulation factor 5/8 type C domain (FA58C) | HMMPfam | 2037-2179, 2190-2336 |
| IPR000421 | Coagulation factor 5/8 type C domain (FA58C) | HMMSmart | 2033-2182, 2186-2339 |
| IPR001117 | Multicopper oxidase, type 1 | ScanRegExp | 2007-2027, 317-337, 699-719 |
| IPR000421 | Coagulation factor 5/8 type C domain (FA58C) | ScanRegExp | 2074-2101, 2231-2260 |
| IPR000421 | Coagulation factor 5/8 type C domain (FA58C) | ScanRegExp | 2166-2182, 2323-2339 |
| IPR000421 | Coagulation factor 5/8 type C domain (FA58C) | ProfileScan | 2034-2182, 2187-2339 |

Variant protein HUMFVIII_PEA_1_P11 is encoded by the following transcript(s): HUMFVIII_PEA_1_T3. The coding portion of transcript HUMFVIII_PEA_1_T3 starts at position 124 and ends at position 7158. The transcript also has the following SNPs as listed in Table 212 (given according to their position on the nucleotide sequence, with the alternative nucleic acid listed; the last column indicates whether the SNP is known or not; the presence of known SNPs in variant protein HUMFVIII_PEA_1_P11 sequence provides support for the deduced sequence of this variant protein according to the present invention).

TABLE 212

Nucleic acid SNPs

| SNP position on nucleotide sequence | Alternative nucleic acid | Previously known SNP? |
|---|---|---|
| 207 | C → T | Yes |
| 329 | A → T | Yes |
| 733 | A → C | Yes |
| 1191 | G → A | Yes |
| 1971 | T → C | Yes |
| 2488 | A → G | Yes |
| 3885 | C → G | Yes |
| 3969 | A → C | Yes |
| 4026 | A → C | Yes |
| 4547 | T → C | Yes |
| 4626 | A → C | Yes |
| 5397 | G → A | Yes |
| 5870 | G → C | Yes |
| 5871 | C → G | Yes |
| 6747 | C → T | Yes |
| 6805 | A → G | No |
| 6805 | A → T | No |
| 6874 | A → G | Yes |
| 6929 | A → G | No |
| 7190 | C → T | Yes |
| 7863 | T → | Yes |
| 8346 | C → T | Yes |
| 8453 | G → A | Yes |
| 8689 | C → A | Yes |
| 8833 | A → G | Yes |

Variant protein HUMFVIII_PEA_1_P13 according to the present invention is encoded by transcript(s) HUMFVIII_PEA_1_T6. An alignment is given to the known protein (Coagulation factor VIII precursor) at the end in FIG. 178 of the application. A brief description of the relationship of the variant protein according to the present invention to each such aligned protein is as follows:

Comparison Report Between HUMFVIII_PEA_1_P13 and FA8_HUMAN:

1. An isolated chimeric polypeptide HUMFVIII_PEA_1_P13, comprising a first amino acid sequence being at least 70%, optionally at least 80%, preferably at least 85%, more preferably at least 90% and most preferably at least 95% homologous to a polypeptide having the sequence MHRDARAQKASRG corresponding to amino acids 1-13 of HUMFVIII_PEA_1_P13, a second amino acid sequence being at least 90% homologous to FPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSH TYVWQVLKENGPMASDPLCLTYSYLSHVDLVKDLNSGLIGALLVCREGSLA KEKTQTLHKFILLFAVFDEGKSWHSETKNSLMQDRDAASARAWPKMHTVNGYVNRSLPG corresponding to amino acids 49-263 of FA8_HUMAN, which also corresponds to amino acids 14-228 of HUMFVIII_PEA_1_P13, and a third amino acid sequence being at least 70%, optionally at least 80%, preferably at least 85%, more preferably at least 90% and most preferably at least 95% homologous to a polypeptide having the sequence MYTPAQQSSGSSKFSTRVLYFSSQTARHLRGYSPLNT corresponding to amino acids 229-265 of HUMFVIII_PEA_

1_P13, wherein said first amino acid sequence, second amino acid sequence and third amino acid sequence are contiguous and in a sequential order.

2. An isolated polypeptide for a head of HUMFVIII_PEA_1_P13, comprising a polypeptide being at least 70%, optionally at least about 80%, preferably at least about 85%, more preferably at least about 90% and most preferably at least about 95% homologous to the sequence MHRDARAQKASRG of HUMFVIII_PEA_1_P13.

3. An isolated polypeptide for a tail of HUMFVIII_PEA_1_P13, comprising a polypeptide being at least 70%, optionally at least about 80%, preferably at least about 85%, more preferably at least about 90% and most preferably at least about 95% homologous to the sequence MYTPAQQSSGSSKFSTRVLYFSSQTARHLRGYSPLNT in HUMFVIII_PEA_1_P13.

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein HUMFVIII_PEA_1_P13 also has the following non-silent SNPs (Single Nucleotide Polymorphisms) as listed in Table 213, (given according to their position(s) on the amino acid sequence, with the alternative amino acid(s) listed; the last column indicates whether the SNP is known or not; the presence of known SNPs in variant protein HUMFVIII_PEA_1_P13 sequence provides support for the deduced sequence of this variant protein according to the present invention).

TABLE 213

| Amino acid mutations | | |
|---|---|---|
| SNP position(s) on amino acid sequence | Alternative amino acid(s) | Previously known SNP? |
| 40 | D → V | Yes |
| 175 | T → P | Yes |

Variant protein HUMFVIII_PEA_1_P13 is encoded by the following transcript(s): HUMFVIII_PEA_1_T6. The coding portion of transcript HUMFVIII_PEA_1_T6 starts at position 124 and ends at position 918. The transcript also has the following SNPs as listed in Table 214 (given according to their position on the nucleotide sequence, with the alternative nucleic acid listed; the last column indicates whether the SNP is known or not; the presence of known SNPs in variant protein HUMFVIII_PEA_1_P13 sequence provides support for the deduced sequence of this variant protein according to the present invention).

TABLE 214

| Nucleic acid SNPs | | |
|---|---|---|
| SNP position on nucleotide sequence | Alternative nucleic acid | Previously known SNP? |
| 242 | A → T | Yes |
| 646 | A → C | Yes |

FIG. 193 depict the domain structure of the variants described hereinabove in comparison to the known or wild-type (WT) protein (Factor VIII).

Example 56

Description for Cluster HUMC1RS

Cluster HUMC1RS features 5 transcript(s) and 41 segment(s) of interest, the names for which are given in Tables 215 and 216, respectively, the sequences themselves are given in SEQ ID NOs: 770-774; 775-815 and 816-820, for transcripts, segments and proteins, respectively. The selected protein variants are given in table 217.

TABLE 215

| Transcripts of interest | |
|---|---|
| Transcript Name | SEQ ID NO: |
| HUMC1RS_PEA_1_T2 | 770 |
| HUMC1RS_PEA_1_T3 | 771 |
| HUMC1RS_PEA_1_T10 | 772 |
| HUMC1RS_PEA_1_T29 | 773 |
| HUMC1RS_PEA_1_T34 | 774 |

TABLE 216

| Segments of interest | |
|---|---|
| Segment Name | SEQ ID NO: |
| HUMC1RS_PEA_1_node_0 | 775 |
| HUMC1RS_PEA_1_node_12 | 776 |
| HUMC1RS_PEA_1_node_16 | 777 |
| HUMC1RS_PEA_1_node_19 | 778 |
| HUMC1RS_PEA_1_node_21 | 779 |
| HUMC1RS_PEA_1_node_24 | 780 |
| HUMC1RS_PEA_1_node_25 | 781 |
| HUMC1RS_PEA_1_node_33 | 782 |
| HUMC1RS_PEA_1_node_44 | 783 |
| HUMC1RS_PEA_1_node_51 | 784 |
| HUMC1RS_PEA_1_node_61 | 785 |
| HUMC1RS_PEA_1_node_62 | 786 |
| HUMC1RS_PEA_1_node_1 | 787 |
| HUMC1RS_PEA_1_node_7 | 788 |
| HUMC1RS_PEA_1_node_8 | 789 |
| HUMC1RS_PEA_1_node_9 | 790 |
| HUMC1RS_PEA_1_node_13 | 791 |
| HUMC1RS_PEA_1_node_26 | 792 |
| HUMC1RS_PEA_1_node_27 | 793 |
| HUMC1RS_PEA_1_node_28 | 794 |

TABLE 216-continued

Segments of interest

| Segment Name | SEQ ID NO: |
|---|---|
| HUMC1RS_PEA_1_node_31 | 795 |
| HUMC1RS_PEA_1_node_32 | 796 |
| HUMC1RS_PEA_1_node_36 | 797 |
| HUMC1RS_PEA_1_node_37 | 798 |
| HUMC1RS_PEA_1_node_38 | 799 |
| HUMC1RS_PEA_1_node_39 | 800 |
| HUMC1RS_PEA_1_node_42 | 801 |
| HUMC1RS_PEA_1_node_46 | 802 |
| HUMC1RS_PEA_1_node_47 | 803 |
| HUMC1RS_PEA_1_node_48 | 804 |
| HUMC1RS_PEA_1_node_49 | 805 |
| HUMC1RS_PEA_1_node_50 | 806 |
| HUMC1RS_PEA_1_node_52 | 807 |
| HUMC1RS_PEA_1_node_53 | 808 |
| HUMC1RS_PEA_1_node_54 | 809 |
| HUMC1RS_PEA_1_node_55 | 810 |
| HUMC1RS_PEA_1_node_56 | 811 |
| HUMC1RS_PEA_1_node_57 | 812 |
| HUMC1RS_PEA_1_node_58 | 813 |
| HUMC1RS_PEA_1_node_59 | 814 |
| HUMC1RS_PEA_1_node_60 | 815 |

TABLE 217

Proteins of interest

| Protein Name | SEQ ID NO: | Protein Length | Corresponding Transcript(s) |
|---|---|---|---|
| HUMC1RS_PEA_1_P8 | 816 | P455 | HUMC1RS_PEA_1_T10 |
| HUMC1RS_PEA_1_P21 | 817 | P405 | HUMC1RS_PEA_1_T29 |
| HUMC1RS_PEA_1_P22 | 818 | P622 | HUMC1RS_PEA_1_T34 |
| HUMC1RS_PEA_1_P23 | 819 | P292 | HUMC1RS_PEA_1_T2 |
| HUMC1RS_PEA_1_P24 | 820 | P330 | HUMC1RS_PEA_1_T3 |

These sequences are variants of the known protein Complement C1s component precursor (SwissProt accession identifier C1S_HUMAN; SEQ ID NO:821; known also according to the synonyms EC 3.4.21.42; C1 esterase), referred to herein as the previously known protein.

Protein Complement C1s component precursor is known or believed to have the following function(s): C1s B chain is a serine protease that combines with C1q and C1s to form C1, the first component of the classical pathway of the complement system. C1r activates C1s so that it can, in turn, activate C2 and C4. The sequence for protein Complement C1s component precursor is given in SEQ ID NO: 821, as "Complement C1s component precursor amino acid sequence". Known polymorphisms for this sequence are as shown in Table 218.

TABLE 218

Amino acid mutations for Known Protein

| SNP position(s) on amino acid sequence | Comment |
|---|---|
| 383 | R → H (in dbSNP: 20573). /FTId = VAR_014565. |
| 294 | C → K |
| 513 | G → GG |
| 573 | T → A |
| 645-646 | TK → GR |

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein or of drugs directed against the protein are as follows: Complement factor 1s inhibitor. A therapeutic role for a protein represented by the cluster has been predicted. The cluster was assigned this field because there was information in the drug database or the public databases (e.g., described herein above) that this protein, or part thereof, is used or can be used for a potential therapeutic indication: Cardiovascular; Anti-inflammatory.

The following GO Annotation(s) apply to the previously known protein. The following annotation(s) were found: proteolysis and peptidolysis; complement activation, classical pathway, which are annotation(s) related to Biological Process; and complement component C1s; chymotrypsin; trypsin; calcium binding; serine-type peptidase; hydrolase, which are annotation(s) related to Molecular Function. The GO assignment relies on information from one or more of the SwissProt/TremB1 Protein knowledgebase, or Locuslink.

FIG. 194 depicts the complement pathway (see for example U.S. Pat. No. 6,010,873).

The first component of complement, C1, comprises two homologous serine proteases, C1r and C1s, assembled with C1q in a tetramer: C1s-C1r-C1r-C1s:C1q C1s and C1r are the proteases responsible for activating the classical pathway via activating the proteolytic activity of the C1 complex: C1r autoactivation, cleavage of C1s by active C1r, cleavage of C4 and C2 by active C1s, generation of C3 convertase.

Uncontrolled activation of C1s can contribute to the pathogenesis of several diseases, including but not limited to ischemia and reperfusion, angioedema, and injury related tissue damage, neurodegenerative diseases (Alzheimer), rheumatoid arthritis.

Deficiency of C1s (as well as C1r) often causes systemic lupus erythematosus-like syndromes, severe pyogenic infections, and accounts for multiple autoimmune diseases.

Complement component C5 participates in both cytolytic and inflammatory processes. Pro-05 is composed of disulfate-linked a- and b-chains designated C5. Activation of the complement system initiates a cascade of proteolytic events in which the two chain-C5 component is cleaved by C5 convertase, and yields the C5a and C5b.

C5a is a powerful mediator of inflammation with anaphylotoxic activity. It elicits its activity via binding to the 7-transmembrane, GPCR, C5a receptor (C5aR), expressed on cells of myeloid origin (neutrophils, eosenophils, and basophils, macrophages and monocytes), epithelial cells, smooth muscle cells and on activated B and T cells. C5aR activation with sub-nanomolar levels of C5a result in chemotaxis of all myeloid lineages, while higher nanomolar concentrations elicit degranulation and activation of NADPH oxidase. C5b triggers the formation of the membrane-attack complex that can damage certain pathogens.

Unregulated C5a production is involved in the following non-limiting list of diseases: adult respiratory distress syndrome, local inflammation, chronic obstructive pulmonary disease (COPD), myocardial ischemia multiple sclerosis, Alzheimer disease, autoimmune disease-related tissue injury, and renal disease.

Complement receptor type I (CR1, or CD35, or C3b/C4b receptor) belongs to the family of regulators of complement activation (RCA). These receptors accelerate the dissociation of C3 and C5 convertases, an activity known as decay accelerating activity (DAA), and/or serve as cofactors for the factor I-mediated cleavage of C3b and C4b, that result in inactivation of these molecules, and which is known as cofactor activity (CA). CR1 is expressed by most peripheral blood cells, but not on platelets, natural killer cells and most T cells.

FIGS. 195, 196, 197 and 198 depict CS-clinical developments, CS, preclinical developments, CR1 clinical development, $C_1$s-clinical developments, respectively.

As noted above, cluster HUMC1RS features 5 transcript(s), which were listed in Table 215 above. These transcript(s) encode for protein(s) which are variant(s) of protein Complement $C_1$s component precursor. A description of each variant protein according to the present invention is now provided.

Variant protein HUMC1RS_PEA_1_P8 according to the present invention is encoded by transcript(s) HUMC1RS_PEA_1_T10. An alignment is given to the known protein (Complement $C_1$s component precursor) in FIG. 179. A brief description of the relationship of the variant protein according to the present invention to each such aligned protein is as follows:

Comparison Report Between HUMC1RS_PEA_1_P8 and C1S_HUMAN:

1. An isolated chimeric polypeptide HUMC1RS_PEA_1_P8, comprising a first amino acid sequence being at least 90% homologous to MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKL QVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQ VVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDV VQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVP corresponding to amino acids 1-423 of C1S_HUMAN, which also corresponds to amino acids 1-423 of HUMC1RS_PEA_1_P8, and a second amino acid sequence being at least 70%, optionally at least 80%, preferably at least 85%, more preferably at least 90% and most preferably at least 95% homologous to a polypeptide having the sequence GLNSDLPESSSVRWQYHCAVGCQGRGEPPQPH corresponding to amino acids 424-455 of HUMC1RS_PEA_1_P8, wherein said first amino acid sequence and second amino acid sequence are contiguous and in a sequential order.

2. An isolated polypeptide for a tail of HUMC1RS_PEA_1_P8, comprising a polypeptide being at least 70%, optionally at least about 80%, preferably at least about 85%, more preferably at least about 90% and most preferably at least about 95% homologous to the sequence GLNSDLPESSSVRWQYHCAVGCQGRGEPPQPH in HUMC1RS_PEA_1_P8.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMC1RS_PEA_1_P8 also has the following non-silent SNPs (Single Nucleotide Polymorphisms) as listed in Table 219, (given according to their position(s) on the amino acid sequence, with the alternative amino acid(s) listed; the last column indicates whether the SNP is known or not; the presence of known SNPs in variant protein HUMC1RS_PEA_1_P8 sequence provides support for the deduced sequence of this variant protein according to the present invention).

TABLE 219

Amino acid mutations

| SNP position(s) on amino acid sequence | Alternative amino acid(s) | Previously known SNP? |
|---|---|---|
| 119 | R → H | Yes |
| 327 | V → L | Yes |
| 334 | A → | No |
| 396 | G → R | No |

The glycosylation sites of variant protein HUMC1RS_PEA_1_P8, as compared to the known protein Complement C1s component precursor, are described in Table 220 (given according to their position(s) on the amino acid sequence in the first column; the second column indicates whether the glycosylation site is present in the variant protein; and the last column indicates whether the position is different on the variant protein).

TABLE 220

Glycosylation site(s)

| Position(s) on known amino acid sequence | Present in variant protein? | Position in variant protein? |
|---|---|---|
| 174 | yes | 174 |
| 406 | yes | 406 |

The phosphorylation sites of variant protein HUMC1RS_PEA_1_P8, as compared to the known protein Complement C1s component precursor, are described in Table 221 (given according to their position(s) on the amino acid sequence in the first column; the second column indicates whether the phosphorylation site is present in the variant protein; and the last column indicates whether the position is different on the variant protein).

TABLE 221

Phosphorylation site(s)

| Position(s) on known amino acid sequence | Present in variant protein? | Position in variant protein? |
|---|---|---|
| 149 | yes | 149 |

The variant protein has the following domains, as determined by using InterPro. The domains are described in Table 222:

TABLE 222

InterPro domain(s)

| InterPro ID | Domain description | Analysis type | Position(s) on protein |
|---|---|---|---|
| IPR006209 | EGF-like domain | HMMPfam | 135-171 |
| IPR000436 | Sushi domain/SCR domain/CCP module | HMMPfam | 294-354, 359-421 |
| IPR000859 | CUB | HMMPfam | 175-287, 18-127 |
| IPR000436 | Sushi domain/SCR domain/CCP module | HMMSmart | 294-354, 359-421 |
| IPR000859 | CUB | HMMSmart | 175-290, 9-130 |
| IPR001881 | EGF-like calcium-binding | HMMSmart | 131-172 |
| IPR000152 | Aspartic acid and asparagine hydroxylation site | ScanRegExp | 147-158 |
| IPR001881 | EGF-like calcium-binding | ScanRegExp | 131-156 |
| IPR000859 | CUB | ProfileScan | 175-290, 3-130 |

Variant protein HUMC1RS_PEA_1_P8 is encoded by the following transcript(s): HUMC1RS_PEA_1_T10. The coding portion of transcript HUMC1RS_PEA_1_T10 starts at position 713 and ends at position 2077. The transcript also has the following SNPs as listed in Table 223 (given according to their position on the nucleotide sequence, with the alternative nucleic acid listed; the last column indicates whether the SNP is known or not; the presence of known SNPs in variant protein HUMC1RS_PEA_1_P8 sequence provides support for the deduced sequence of this variant protein according to the present invention).

TABLE 223

Nucleic acid SNPs

| SNP position on nucleotide sequence | Alternative nucleic acid | Previously known SNP? |
|---|---|---|
| 417 | G → T | No |
| 693 | G → | No |
| 1068 | G → A | Yes |
| 1074 | → A | No |
| 1074 | → G | No |
| 1153 | C → T | Yes |
| 1691 | G → C | Yes |
| 1714 | A → | No |
| 1879 | A → G | Yes |
| 1898 | G → A | No |
| 1898 | G → C | No |
| 2644 | A → C | No |
| 2678 | C → G | No |
| 2768 | C → T | No |
| 2789 | G → A | No |
| 2863 | A → T | Yes |
| 2889 | C → T | No |
| 3058 | G → T | Yes |
| 3081 | A → G | Yes |
| 3099 | C → T | Yes |
| 3117 | C → T | Yes |
| 3132 | G → C | Yes |
| 3189 | G → C | Yes |
| 3247 | C → T | Yes |
| 3254 | C → T | Yes |
| 3340 | A → C | Yes |

Variant protein HUMC1RS_PEA_1_P21 according to the present invention is encoded by transcript(s) HUMC1RS_PEA_1_T29. An alignment is given to the known protein (Complement C1s component precursor) in FIG. 180. A brief description of the relationship of the variant protein according to the present invention to each such aligned protein is as follows:

Comparison Report Between HUMC1RS_PEA_1_P21 and C1S_HUMAN:

1. An isolated chimeric polypeptide HUMC1RS_PEA_1_P21, comprising a first amino acid sequence being at least 90% homologous to MWCIVLFSLLAWVYAEPT-MYGEILSPNYPQAYPSEVEKSWDIEVPEGYGIHL YFTHLDIELSENCAYDSVQIISGDTEE-GRLCGQRSSNNPHSPIVEEFQVPYNKL QVIFKSDFS-NEERFTGFAAYYVATDINECTDFVDVPC-SHFCNNFIGGYFCSCPP EYFLHDDMKNCGVNCSGDVFTALIGE-IASPNYPKPYPENSRCEYQIRLEKGFQ VVVTLRRED- FDVEAADSAGNCLDSLVFVAGDRQFGPYCGHGFPGPLNIETKSNALDIIFQTDLTGQKKGWKLRYHGDPMPCPKEDTPNSVWEPAKAKYVFRDV VQITCLDGFEVVEGRVGATSFYSTCQSNGKWSNSKLKCQ corresponding to amino acids 1-355 of C1S_HUMAN, which also corresponds to amino acids 1-355 of HUMC1RS_PEA_1_P21, and a second amino acid sequence being at least 70%, optionally at least 80%, preferably at least 85%, more preferably at least 90% and most preferably at least 95% homologous to a polypeptide having the sequence RMCLFKVEVFLFLSERMERSAHQNSNAWFPLRHVREWVGFLKGSQSWKLF corresponding to amino acids 356-405 of HUMC1RS_PEA_1_P21, wherein said first amino acid sequence and second amino acid sequence are contiguous and in a sequential order.

2. An isolated polypeptide for a tail of HUMC1RS_PEA_1_P21, comprising a polypeptide being at least 70%, optionally at least about 80%, preferably at least about 85%, more preferably at least about 90% and most preferably at least about 95% homologous to the sequence RMCLFKVEVFLFLSERMERSAHQNSNAWFPLRHVREWVGFLKGSQSWKLF in HUMC1RS_PEA_1_P21.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMC1RS_PEA_1_P21 also has the following non-silent SNPs (Single Nucleotide Polymorphisms) as listed in Table 224, (given according to their position(s) on the amino acid sequence, with the alternative amino acid(s) listed; the last column indicates whether the SNP is known or not; the presence of known SNPs in variant protein HUMC1RS_PEA_1_P21 sequence provides support for the deduced sequence of this variant protein according to the present invention).

TABLE 224

| Amino acid mutations | | |
| --- | --- | --- |
| SNP position(s) on amino acid sequence | Alternative amino acid(s) | Previously known SNP? |
| 119 | R → H | Yes |
| 327 | V → L | Yes |
| 334 | A → | No |

The glycosylation sites of variant protein HUMC1RS_PEA_1_P21, as compared to the known protein Complement C1s component precursor, are described in Table 225 (given according to their position(s) on the amino acid sequence in the first column; the second column indicates whether the glycosylation site is present in the variant protein; and the last column indicates whether the position is different on the variant protein).

TABLE 225

| Glycosylation site(s) | | |
| --- | --- | --- |
| Position(s) on known amino acid sequence | Present in variant protein? | Position in variant protein? |
| 174 | yes | 174 |
| 406 | no | |

The phosphorylation sites of variant protein HUMC1RS_PEA_1_P21, as compared to the known protein Complement C1s component precursor, are described in Table 226 (given according to their position(s) on the amino acid sequence in the first column; the second column indicates whether the phosphorylation site is present in the variant protein; and the last column indicates whether the position is different on the variant protein).

TABLE 226

| Phosphorylation site(s) | | |
| --- | --- | --- |
| Position(s) on known amino acid sequence | Present in variant protein? | Position in variant protein? |
| 149 | yes | 149 |

The variant protein has the following domains, as determined by using InterPro. The domains are described in Table 227:

TABLE 227

| InterPro domain(s) | | | |
| --- | --- | --- | --- |
| InterPro ID | Domain description | Analysis type | Position(s) on protein |
| IPR006209 | EGF-like domain | HMMPfam | 135-171 |
| IPR000436 | Sushi domain/SCR domain/CCP module | HMMPfam | 294-354 |
| IPR000859 | CUB | HMMPfam | 175-287, 18-127 |
| IPR000436 | Sushi domain/SCR domain/CCP module | HMMSmart | 294-354 |
| IPR000859 | CUB | HMMSmart | 175-290, 9-130 |
| IPR001881 | EGF-like calcium-binding | HMMSmart | 131-172 |
| IPR000152 | Aspartic acid and asparagine hydroxylation site | ScanRegExp | 147-158 |
| IPR001881 | EGF-like calcium-binding | ScanRegExp | 131-156 |
| IPR000859 | CUB | ProfileScan | 175-290, 3-130 |

Variant protein HUMC1RS_PEA_1_P21 is encoded by the following transcript(s): HUMC1RS_PEA_1_T29. The coding portion of transcript HUMC1RS_PEA_1_T29 starts at position 713 and ends at position 1927. The transcript also has the following SNPs as listed in Table 228 (given according to their position on the nucleotide sequence, with the alternative nucleic acid listed; the last column indicates whether the SNP is known or not; the presence of known SNPs in variant protein HUMC1RS_PEA_1_P21 sequence provides support for the deduced sequence of this variant protein according to the present invention).

TABLE 228

Nucleic acid SNPs

| SNP position on nucleotide sequence | Alternative nucleic acid | Previously known SNP? |
|---|---|---|
| 417 | G → T | No |
| 693 | G → | No |
| 1068 | G → A | Yes |
| 1074 | → A | No |
| 1074 | → G | No |
| 1153 | C → T | Yes |
| 1691 | G → C | Yes |
| 1714 | A → | No |

Variant protein HUMC1RS_PEA_1_P22 according to the present invention is encoded by transcript(s) HUMC1RS_PEA_1_T34. An alignment is given to the known protein (Complement C1s component precursor) in FIG. 181. A brief description of the relationship of the variant protein according to the present invention to each such aligned protein is as follows:

Comparison Report Between HUMC1RS_PEA_1_P22 and C1S_HUMAN:

1. An isolated chimeric polypeptide HUMC1RS_PEA_1_P22, comprising a first amino acid sequence being at least 90% homologous to MWCIVLFSLLAWVYAEPT-MYGEILSPNYPQAYPSEVEKSWDIEVPEGYGIHL YFTHLDIELSEN corresponding to amino acids 1-64 of C1S_HUMAN, which also corresponds to amino acids 1-64 of HUMC1RS_PEA_1_P22, a second amino acid sequence bridging amino acid sequence comprising of Y, and a third amino acid sequence being at least 90% homologous to INECTDFVDVPCSHFCNNFIGGYFC-SCPPEYFLHDDMKNCGVNCSGDVFTALI GEIASP-NYPKPYPENSRCEYQIRLEKGFQVVVTL-RREDFDVEAADSAGNCLDS LVFVAGDRQFGPYCGHGFPGPLNIETK-SNALDIIFQTDLTGQKKGWKLRYHG DPMPCPKEDT-PNSVWEPAKAKYVFRDVVQITCLDGFE-VVEGRVGATSFYSTC QSNGKWSNSKLKCQPVDC-GIPESIENGKVEDPESTLFGSVIRYTCEEPYYYME NGGGGEYHCAGNGSWVNEVLGPELP-KCVPVCGVPREPFEEKQRIIGGSDADI KNFP-WQVFFDNPWAGGALINEYWVLTAAH-VVEGNREPTMYVGSTSVQTSRL AKSKMLTPEHVFIHPGWKLLEVPEGRTN-FDNDIALVRLKDPVKMGPTVSPICL PGTSSDYN-LMDGDLGLISGWGRTEKRDRAVRLKAAR-LPVAPLRKCKEVKVE KPTADAEAYVFTPNMICAGGEKGMDSCK-GDSGGAFAVQDPNDKTKFYAAG LVSWGPQCGTYG-LYTRVKNYVDWIMKTMQENSTPRED corresponding to amino acids 132-688 of C1S_HUMAN, which also corresponds to amino acids 66-622 of HUMC1RS_PEA_1_P22, wherein said first amino acid sequence, second amino acid sequence and third amino acid sequence are contiguous and in a sequential order.

2. An isolated edge portion of HUMC1RS_PEA_1_P22, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NYI having a structure as follows (numbering according to HUMC1RS_PEA_1_P22): a sequence starting from any of amino acid numbers 64-x to 64; and ending at any of amino acid numbers 66+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMC1RS_PEA_1_P22 also has the following non-silent SNPs (Single Nucleotide Polymorphisms) as listed in Table 229, (given according to their position(s) on the amino acid sequence, with the alternative amino acid(s) listed; the last column indicates whether the SNP is known or not; the presence of known SNPs in variant protein HUMC1RS_PEA_1_P22 sequence provides support for the deduced sequence of this variant protein according to the present invention).

TABLE 229

Amino acid mutations

| SNP position(s) on amino acid sequence | Alternative amino acid(s) | Previously known SNP? |
|---|---|---|
| 261 | V → L | Yes |
| 268 | A → | No |
| 330 | G → R | No |
| 507 | T → P | No |
| 518 | A → G | No |
| 548 | P → L | No |
| 555 | G → E | No |
| 580 | K → * | Yes |

The glycosylation sites of variant protein HUMC1RS_PEA_1_P22, as compared to the known protein Complement C1s component precursor, are described in Table 230 (given according to their position(s) on the amino acid sequence in the first column; the second column indicates whether the glycosylation site is present in the variant protein; and the last column indicates whether the position is different on the variant protein).

TABLE 230

Glycosylation site(s)

| Position(s) on known amino acid sequence | Present in variant protein? | Position in variant protein? |
|---|---|---|
| 174 | yes | 108 |
| 406 | yes | 340 |

The phosphorylation sites of variant protein HUMC1RS_PEA_1_P22, as compared to the known protein Complement C1s component precursor, are described in Table 231 (given according to their position(s) on the amino acid sequence in the first column; the second column indicates whether the phosphorylation site is present in the variant protein; and the last column indicates whether the position is different on the variant protein).

TABLE 231

Phosphorylation site(s)

| Position(s) on known amino acid sequence | Present in variant protein? | Position in variant protein? |
|---|---|---|
| 149 | yes | 83 |

The variant protein has the following domains, as determined by using InterPro. The domains are described in Table 232:

TABLE 232

InterPro domain(s)

| InterPro ID | Domain description | Analysis type | Position(s) on protein |
|---|---|---|---|
| IPR001254 | Peptidase S1, chymotrypsin | ProfileScan | 372-614 |
| IPR001314 | Peptidase S1A, chymotrypsin | FPrintScan | 395-410, 459-473, 559-571 |
| IPR006209 | EGF-like domain | HMMPfam | 69-105 |
| IPR000436 | Sushi domain/SCR domain/CCP module | HMMPfam | 228-288, 293-355 |
| IPR001254 | Peptidase S1, chymotrypsin | HMMPfam | 372-609 |
| IPR000859 | CUB | HMMPfam | 109-221 |
| IPR001254 | Peptidase S1, chymotrypsin | HMMSmart | 371-609 |
| IPR000436 | Sushi domain/SCR domain/CCP module | HMMSmart | 228-288, 293-355 |
| IPR000859 | CUB | HMMSmart | 109-224, 9-104 |
| IPR001881 | EGF-like calcium-binding | HMMSmart | 66-106 |
| IPR000152 | Aspartic acid and asparagine hydroxylation site | ScanRegExp | 81-92 |
| IPR001254 | Peptidase S1, chymotrypsin | ScanRegExp | 560-571 |
| IPR000859 | CUB | ProfileScan | 109-224, 3-91 |

Variant protein HUMC1RS_PEA_1_P22 is encoded by the following transcript(s): HUMC1RS_PEA_1_T34. The coding portion of transcript HUMC1RS_PEA_1_T34 starts at position 713 and ends at position 2578. The transcript also has the following SNPs as listed in Table 233 (given according to their position on the nucleotide sequence, with the alternative nucleic acid listed; the last column indicates whether the SNP is known or not; the presence of known SNPs in variant protein HUMC1RS_PEA_1_P22 sequence provides support for the deduced sequence of this variant protein according to the present invention).

TABLE 233

Nucleic acid SNPs

| SNP position on nucleotide sequence | Alternative nucleic acid | Previously known SNP? |
|---|---|---|
| 417 | G → T | No |
| 693 | G → | No |
| 955 | C → T | Yes |
| 1493 | G → C | Yes |
| 1516 | A → | No |
| 1681 | A → G | Yes |
| 1700 | G → A | No |
| 1700 | G → C | No |
| 2231 | A → C | No |
| 2265 | C → G | No |
| 2355 | C → T | No |
| 2376 | G → A | No |
| 2450 | A → T | Yes |
| 2476 | C → T | No |

TABLE 233-continued

Nucleic acid SNPs

| SNP position on nucleotide sequence | Alternative nucleic acid | Previously known SNP? |
|---|---|---|
| 2645 | G → T | Yes |
| 2668 | A → G | Yes |
| 2686 | C → T | Yes |
| 2704 | C → T | Yes |
| 2719 | G → C | Yes |
| 2776 | G → C | Yes |
| 2834 | C → T | Yes |
| 2841 | C → T | Yes |
| 2927 | A → C | Yes |

Variant protein HUMC1RS_PEA_1_P23 according to the present invention is encoded by transcript(s) HUMC1RS_PEA_1_T2. An alignment is given to the known protein (Complement C1s component precursor) in FIG. 182. A brief description of the relationship of the variant protein according to the present invention to each such aligned protein is as follows:

Comparison Report Between HUMC1RS_PEA_1_P23 and C1S_HUMAN:

1. An isolated chimeric polypeptide HUMC1RS_PEA_1_P23, comprising a first amino acid sequence being at least 90% homologous to MWCIVLFSLLAWVYAEPT-MYGEILSPNYPQAYPSEVEKSWDIEVPEGYGIHL YFTHLDIELSENCAYDSVQIISGDTEE-GRLCGQRSSNNPHSPIVEEFQVPYNKL QVIFKSDFS-NEERFTGFAAYYVATDINECTDFVDVPC-SHFCNNFIGGYFCSCPP EYFLHDDMKNCGVNCSGDVFTALIGE-IASPNYPKPYPENSRCEYQIRLEKGFQ VVVTLRRED- FDVEAADSAGNCLDSLVFVAGDRQFGPY-
CGHGFPGPLNIETKS
NALDIIFQTDLTGQKKGWKLRYHGD corresponding to amino acids 1-290 of C1S_HUMAN, which also corresponds to amino acids 1-290 of HUMC1RS_PEA_1_P23, and a second amino acid sequence being at least 70%, optionally at least 80%, preferably at least 85%, more preferably at least 90% and most preferably at least 95% homologous to a polypeptide having the sequence RE corresponding to amino acids 291-292 of HUMC1RS_PEA_1_P23, wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMC1RS_PEA_1_P23 also has the following non-silent SNPs (Single Nucleotide Polymorphisms) as listed in Table 234, (given according to their position(s) on the amino acid sequence, with the alternative amino acid(s) listed; the last column indicates whether the SNP is known or not; the presence of known SNPs in variant protein HUMC1RS_PEA_1_P23 sequence provides support for the deduced sequence of this variant protein according to the present invention).

TABLE 234

Amino acid mutations

| SNP position(s) on amino acid sequence | Alternative amino acid(s) | Previously known SNP? |
|---|---|---|
| 119 | R → H | Yes |

The glycosylation sites of variant protein HUMC1RS_PEA_1_P23, as compared to the known protein Complement C1s component precursor, are described in Table 235 (given according to their position(s) on the amino acid sequence in the first column; the second column indicates whether the glycosylation site is present in the variant protein; and the last column indicates whether the position is different on the variant protein).

TABLE 235

Glycosylation site(s)

| Position(s) on known amino acid sequence | Present in variant protein? | Position in variant protein? |
|---|---|---|
| 174 | yes | 174 |
| 406 | no | |

The phosphorylation sites of variant protein HUMC1RS_PEA_1_P23, as compared to the known protein Complement C1s component precursor, are described in Table 236 (given according to their position(s) on the amino acid sequence in the first column; the second column indicates whether the phosphorylation site is present in the variant protein; and the last column indicates whether the position is different on the variant protein).

TABLE 236

Phosphorylation site(s)

| Position(s) on known amino acid sequence | Present in variant protein? | Position in variant protein? |
|---|---|---|
| 149 | yes | 149 |

The variant protein has the following domains, as determined by using InterPro. The domains are described in Table 237:

TABLE 237

InterPro domain(s)

| InterPro ID | Domain description | Analysis type | Position(s) on protein |
|---|---|---|---|
| IPR006209 | EGF-like domain | HMMPfam | 135-171 |
| IPR000859 | CUB | HMMPfam | 16-127, 175-287 |
| IPR001881 | EGF-like calcium-binding | HMMPfam | 131-171 |
| IPR000859 | CUB | HMMSmart | 175-290, 9-130 |
| IPR001881 | EGF-like calcium-binding | HMMSmart | 131-172 |
| IPR000152 | Aspartic acid and asparagine hydroxylation site | ScanRegExp | 147-158 |
| IPR001881 | EGF-like calcium-binding | ScanRegExp | 131-156 |
| IPR000859 | CUB | ProfileScan | 175-290, 3-130 |

Variant protein HUMC1RS_PEA_1_P23 is encoded by the following transcript(s): HUMC1RS_PEA_1_T2. The coding portion of transcript HUMC1RS_PEA_1_T2 starts at position 713 and ends at position 1588. The transcript also has the following SNPs as listed in Table 238 (given according to their position on the nucleotide sequence, with the alternative nucleic acid listed; the last column indicates whether the SNP is known or not; the presence of known SNPs in variant protein HUMC1RS_PEA_1_P23 sequence provides support for the deduced sequence of this variant protein according to the present invention).

TABLE 238

Nucleic acid SNPs

| SNP position on nucleotide sequence | Alternative nucleic acid | Previously known SNP? |
|---|---|---|
| 417 | G → T | No |
| 693 | G → | No |
| 1068 | G → A | Yes |
| 1074 | → A | No |
| 1074 | → G | No |
| 1153 | C → T | Yes |
| 2238 | G → C | Yes |
| 2261 | A → | No |
| 2426 | A → G | Yes |
| 2445 | G → A | No |
| 2445 | G → C | No |
| 2976 | A → C | No |
| 3010 | C → G | No |
| 3100 | C → T | No |
| 3121 | G → A | No |
| 3195 | A → T | Yes |
| 3221 | C → T | No |
| 3390 | G → T | Yes |
| 3413 | A → G | Yes |
| 3431 | C → T | Yes |
| 3449 | C → T | Yes |
| 3464 | G → C | Yes |

TABLE 238-continued

Nucleic acid SNPs

| SNP position on nucleotide sequence | Alternative nucleic acid | Previously known SNP? |
|---|---|---|
| 3521 | G → C | Yes |
| 3579 | C → T | Yes |
| 3586 | C → T | Yes |
| 3672 | A → C | Yes |

Variant protein HUMC1RS_PEA_1_P24 according to the present invention is encoded by transcript(s) HUMC1RS_PEA_1_T3. An alignment is given to the known protein (Complement C1s component precursor) in FIG. 183. A brief description of the relationship of the variant protein according to the present invention to each such aligned protein is as follows:

Comparison Report Between HUMC1RS_PEA_1_P24 and C1S_HUMAN:

1. An isolated chimeric polypeptide HUMC1RS_PEA_1_P24, comprising a first amino acid sequence being at least 90% homologous to MWCIVLFSLLAWVYAEPT-MYGEILSPNYPQAYPSEVEKSWDIEVPEGYGIHL YFTHLDIELSENCAYDSVQIISGDTEE-GRLCGQRSSNNPHSPIVEEFQVPYNKL QVIFKSDFS-NEERFTGFAAYYVATDINECTDFVDVPC-SHFCNNFIGGYFCSCPP EYFLHDDMKNCGVNCSGDVFTALIGE-IASPNYPKPYPENSRCEYQIRLEKGFQ VVVTLRRED-FDVEAADSAGNCLDSLVFVAGDRQFGPY-CGHGFPGPLNIETKS NALDIIFQTDLTGQKKGWKLRYHGDP-MPCPKEDTPNSVWEPAKAKYVFRDV VQITCLDGFE-VVE corresponding to amino acids 1-329 of C1S_HUMAN, which also corresponds to amino acids 1-329 of HUMC1RS_PEA_1_P24, and a second amino acid sequence being at least 70%, optionally at least 80%, preferably at least 85%, more preferably at least 90% and most preferably at least 95% homologous to a polypeptide having the sequence K corresponding to amino acids 330-330 of HUMC1RS_PEA_1_P24, wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMC1RS_PEA_1_P24 also has the following non-silent SNPs (Single Nucleotide Polymorphisms) as listed in Table 239, (given according to their position(s) on the amino acid sequence, with the alternative amino acid(s) listed; the last column indicates whether the SNP is known or not; the presence of known SNPs in variant protein HUMC1RS_PEA_1_P24 sequence provides support for the deduced sequence of this variant protein according to the present invention).

TABLE 239

Amino acid mutations

| SNP position(s) on amino acid sequence | Alternative amino acid(s) | Previously known SNP? |
|---|---|---|
| 119 | R → H | Yes |
| 327 | V → L | Yes |

The glycosylation sites of variant protein HUMC1RS_PEA_1_P24, as compared to the known protein Complement C1s component precursor, are described in Table 240 (given according to their position(s) on the amino acid sequence in the first column; the second column indicates whether the glycosylation site is present in the variant protein; and the last column indicates whether the position is different on the variant protein).

TABLE 240

Glycosylation site(s)

| Position(s) on known amino acid sequence | Present in variant protein? | Position in variant protein? |
|---|---|---|
| 174 | yes | 174 |
| 406 | no | |

The phosphorylation sites of variant protein HUMC1RS_PEA_1_P24, as compared to the known protein Complement C1s component precursor, are described in Table 241 (given according to their position(s) on the amino acid sequence in the first column; the second column indicates whether the phosphorylation site is present in the variant protein; and the last column indicates whether the position is different on the variant protein).

TABLE 241

Phosphorylation site(s)

| Position(s) on known amino acid sequence | Present in variant protein? | Position in variant protein? |
|---|---|---|
| 149 | yes | 149 |

The variant protein has the following domains, as determined by using InterPro. The domains are described in Table 242:

TABLE 242

InterPro domain(s)

| InterPro ID | Domain description | Analysis type | Position(s) on protein |
|---|---|---|---|
| IPR006209 | EGF-like domain | HMMPfam | 135-171 |
| IPR000859 | CUB | HMMPfam | 16-127, 175-287 |
| IPR001881 | EGF-like calcium-binding | HMMPfam | 131-171 |
| IPR000859 | CUB | HMMSmart | 175-290, 9-130 |
| IPR001881 | EGF-like calcium-binding | HMMSmart | 131-172 |
| IPR000152 | Aspartic acid and asparagine hydroxylation site | ScanRegExp | 147-158 |
| IPR001881 | EGF-like calcium-binding | ScanRegExp | 131-156 |
| IPR000859 | CUB | ProfileScan | 175-290, 3-130 |

Variant protein HUMC1RS_PEA_1_P24 is encoded by the following transcript(s): HUMC1RS_PEA_1_T3. The coding portion of transcript HUMC1RS_PEA_1_T3 starts at position 713 and ends at position 1702. The transcript also has the following SNPs as listed in Table 243 (given according to their position on the nucleotide sequence, with the alternative nucleic acid listed; the last column indicates whether the SNP is known or not; the presence of known SNPs in variant protein HUMC1RS_PEA_1_P24 sequence provides support for the deduced sequence of this variant protein according to the present invention).

TABLE 243

Nucleic acid SNPs

| SNP position on nucleotide sequence | Alternative nucleic acid | Previously known SNP? |
|---|---|---|
| 417 | G → T | No |
| 693 | G → | No |
| 1068 | G → A | Yes |
| 1074 | → A | No |
| 1074 | → G | No |
| 1153 | C → T | Yes |
| 1691 | G → C | Yes |
| 1744 | A → | No |
| 1909 | A → G | Yes |
| 1928 | G → A | No |
| 1928 | G → C | No |
| 2459 | A → C | No |
| 2493 | C → G | No |
| 2583 | C → T | No |
| 2604 | G → A | No |
| 2678 | A → T | Yes |
| 2704 | C → T | No |
| 2873 | G → T | Yes |
| 2896 | A → G | Yes |
| 2914 | C → T | Yes |
| 2932 | C → T | Yes |
| 2947 | G → C | Yes |
| 3004 | G → C | Yes |
| 3062 | C → T | Yes |
| 3069 | C → T | Yes |
| 3155 | A → C | Yes |

FIG. 199 depicts the domain structure of the variants described hereinabove in comparison to the known or wild-type (WT) protein Example 57

Description for Cluster HSGROW1

Cluster HSGROW1 features 5 transcript(s) and 22 segment(s) of interest, the names for which are given in Tables 244 and 245, respectively, the sequences themselves are given in SEQ ID NOs: 822-826; 827-848 and 851-855, for transcripts, segments and proteins, respectively. The selected protein variants are given in table 246.

TABLE 244

Transcripts of interest

| Transcript Name | SEQ ID NO: |
|---|---|
| HSGROW1_PEA_1_T6 | 822 |
| HSGROW1_PEA_1_T10 | 823 |
| HSGROW1_PEA_1_T11 | 824 |
| HSGROW1_PEA_1_T12 | 825 |
| HSGROW1_PEA_1_T18 | 826 |

TABLE 245

Segments of interest

| Segment Name | SEQ ID NO: |
|---|---|
| HSGROW1_PEA_1_node_2 | 827 |
| HSGROW1_PEA_1_node_16 | 828 |
| HSGROW1_PEA_1_node_22 | 829 |
| HSGROW1_PEA_1_node_0 | 830 |
| HSGROW1_PEA_1_node_4 | 831 |
| HSGROW1_PEA_1_node_5 | 832 |
| HSGROW1_PEA_1_node_6 | 833 |
| HSGROW1_PEA_1_node_7 | 834 |
| HSGROW1_PEA_1_node_9 | 835 |
| HSGROW1_PEA_1_node_10 | 836 |
| HSGROW1_PEA_1_node_11 | 837 |
| HSGROW1_PEA_1_node_12 | 838 |
| HSGROW1_PEA_1_node_13 | 839 |
| HSGROW1_PEA_1_node_14 | 840 |
| HSGROW1_PEA_1_node_15 | 841 |
| HSGROW1_PEA_1_node_17 | 842 |
| HSGROW1_PEA_1_node_18 | 843 |
| HSGROW1_PEA_1_node_19 | 844 |
| HSGROW1_PEA_1_node_20 | 845 |
| HSGROW1_PEA_1_node_21 | 846 |
| HSGROW1_PEA_1_node_23 | 847 |
| HSGROW1_PEA_1_node_24 | 848 |

TABLE 246

Proteins of interest

| Protein Name | SEQ ID NO: | Corresponding Transcript(s) |
|---|---|---|
| HSGROW1_PEA_1_P7 | 851 | HSGROW1_PEA_1_T6 |
| HSGROW1_PEA_1_P11 | 852 | HSGROW1_PEA_1_T10 |
| HSGROW1_PEA_1_P12 | 853 | HSGROW1_PEA_1_T11 |
| HSGROW1_PEA_1_P18 | 854 | HSGROW1_PEA_1_T18 |
| HSGROW1_PEA_1_P21 | 855 | HSGROW1_PEA_1_T12 |

These sequences are variants of the known protein Somatotropin precursor (SwissProt accession identifier SOMA_HUMAN; SEQ ID NO:850; known also according to the synonyms Growth hormone; GH; GH-N; Pituitary growth hormone; Growth hormone 1), referred to herein as the previously known protein.

Protein Somatotropin precursor is known or believed to have the following function(s): Plays an important role in growth control. Its major role in stimulating body growth is to stimulate the liver and other tissues to secrete IGF-1. It stimulates both the differentiation and proliferation of myoblasts. It also stimulates amino acid uptake and protein synthesis in muscle and other tissues. The sequence for protein Somatotropin precursor is given in SEQ ID NO: 850, as "Somatotropin precursor amino acid sequence". Known polymorphisms for this sequence are as shown in Table 247.

TABLE 247

Amino acid mutations for Known Protein

| SNP position(s) on amino acid sequence | Comment |
|---|---|
| 3 | T → A (in IGHD IB; dbSNP: 2001345). /FTId = VAR_011917. |
| 16 | L → P (in IGHD IB; supresses secretion). /FTId = VAR_015801. |
| 37 | D → N (in IGHD IB). /FTId = VAR_015802. |
| 42 | R → C (in IGHD IB; reduced secretion). /FTId = VAR_015803. |
| 53 | T → I (in IGHD IB; reduced ability to activate the JAK/STAT pathway). /FTId = VAR_015804. |
| 67 | K → R (in IGHD IB; reduced ability to activate the JAK/STAT pathway). /FTId = VAR_015805. |
| 73 | N → D (in IGHD IB; reduced ability to activate the JAK/STAT pathway). /FTId = VAR_015806. |
| 97 | S → F (in IGHD IB; reduced ability to activate the JAK/STAT pathway). /FTId = VAR_015807. |
| 100 | E → K (in IGHD IB). /FTId = VAR_015808. |
| 103 | R → C (in Kowarski syndrome; loss of activity). /FTId = VAR_015809. |
| 105 | S → C (in dbSNP: 6174). /FTId = VAR_011918. |
| 117 | Q → L (in IGHD IB; reduced secretion). /FTId = VAR_015810. |
| 134 | S → C (in IGHD IB). /FTId = VAR_015811. |
| 134 | S → R (in IGHD IB; reduced ability to activate the JAK/STAT pathway). /FTId = VAR_015812. |
| 136 | V → I (in dbSNP: 5388). /FTId = VAR_011919. |
| 138 | D → G (in Kowarski syndrome; loss of activity). /FTId = VAR_015813. |
| 201 | T → A (in IGHD IB; reduced ability to activate the JAK/STAT pathway). /FTId = VAR_015814. |
| 209 | R → H (in IGHD II). /FTId = VAR_015815. |
| 35 | L → P |
| 40 | M → S |

Protein Somatotropin precursor localization is believed to be Secreted.

The previously known protein also has the following indication(s) and/or potential therapeutic use(s): Diabetes, Type II; Acromegaly; Sex-chromosome abnormality, Turner's syndrome; Growth hormone deficiency; Dwarfism; Burns; Cachexia; Osteoporosis; Uraemia; Short-bowel syndrome; Lipodystrophy; Infertility, female; Regeneration, bone; Wound healing. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Growth factor agonist; Growth hormone releasing factor agonist; Growth hormone modulator. A therapeutic role for a protein represented by the cluster has been predicted. The cluster was assigned this field because there was information in the drug database or the public databases (e.g., described herein above) that this protein, or part thereof, is used or can be used for a potential therapeutic indication: Antidiabetic; Symptomatic antidiabetic; Urological; Somatostatin; Anticancer; Ophthalmological; Growth hormone; Reproductive/gonadal, general; Musculoskeletal; Gene therapy; GI inflammatory/bowel disorders; Hypolipaemic/Antiatherosclerosis; Anabolic; Fertility enhancer; Vulnerary; Releasing hormone; Alimentary/Metabolic; Anorectic/Antiobesity.

The following GO Annotation(s) apply to the previously known protein. The following annotation(s) were found: signal transduction, which are annotation(s) related to Biological Process; and hormone; peptide hormone, which are annotation(s) related to Molecular Function.

The GO assignment relies on information from one or more of the SwissProt/TremBl Protein knowledgebase, or Locuslink.

Growth Hormone (GH) plays an important role in growth with (among others) the following important activities: stimulates the production of IGF-1 and stimulates amino acid uptake and protein synthesis in muscles and other tissues. Receptor Binding occurs through dimerization-GH first binds via site 1 to GH receptor and through site 2 to another GH hormone receptor forming the complex GHR/GH/GHR. Clinical use includes (among other indications) pituitary dwarfism and Turner's syndrome (agonist); and acromelagy—a disease that affects middle aged adults in which there is excess GH, which causes overgrowth of bone and cartilage (antagonist).

FIG. 200 depicts GH antagonists-launched products and FIG. 201 depicts GH antagonists-clinical development.

As noted above, cluster HSGROW1 features 5 transcript(s), which were listed in Table 244 above. These transcript(s) encode for protein(s) which are variant(s) of protein Somatotropin precursor. A description of each variant protein according to the present invention is now provided.

Variant protein HSGROW1_PEA_1_P7 according to the present invention is encoded by transcript(s) HSGROW1_PEA_1_T6. An alignment is given to the known protein (Somatotropin precursor) in FIG. 184. A brief description of the relationship of the variant protein according to the present invention to each such aligned protein is as follows:

Comparison Report Between HSGROW1_PEA_1_P7 and SOMA_HUMAN:

1. An isolated chimeric polypeptide HSGROW1_PEA_1_P7, comprising a first amino acid sequence being at least 90% homologous to MATGSRTSLLLAFGLLCLPWLQEG-SAFPTIPLSRLFDNAMLRAHRLHQLAFDT YQEF corresponding to amino acids 1-57 of SOMA_HUMAN, which also corresponds to amino acids 1-57 of HSGROW1_PEA_1_P7, and a second amino acid sequence being at least 90% homologous to TSLCFSESIPTPSNREETQQKSNLELL-RISLLLIQSWLEPVQFLRSVFANSLVYG ASDSNVY-DLLKDLEEGIQTLMGRLEDGSPRTG-QIFKQTYSKFDTNSHNDDAL LKNYGLLYCFRKDMDKVETFLRIVQCRSVEGSCGF corresponding to amino acids 76-217 of SOMA_HUMAN, which also corresponds to amino acids 58-199 of HSGROW1_PEA_1_P7, wherein said first amino acid sequence and second amino acid sequence are contiguous and in a sequential order.

2. An isolated chimeric polypeptide for an edge portion of HSGROW1_PEA_1_P7, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise FT, having a structure as follows: a sequence starting from any of amino acid numbers 57-x to 57; and ending at any of amino acid numbers 58+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure. Variant protein HSGROW1_PEA_1_P7 also has the following non-silent SNPs (Single Nucleotide Polymorphisms) as listed in Table 248, (given according to their position(s) on the amino acid sequence, with the alternative amino acid(s) listed; the last column indicates whether the SNP is known or not; the presence of known SNPs in variant protein HSGROW1_PEA_1_P7 sequence provides support for the deduced sequence of this variant protein according to the present invention).

TABLE 248

Amino acid mutations

| SNP position(s) on amino acid sequence | Alternative amino acid(s) | Previously known SNP? |
|---|---|---|
| 12 | A → S | Yes |
| 12 | A → P | Yes |
| 59 | S → | No |
| 59 | S → F | No |
| 69 | P → T | No |
| 79 | S → | No |
| 84 | L → | No |
| 91 | I → | No |
| 106 | A → | No |
| 121 | L → | No |
| 174 | F → C | Yes |
| 174 | F → Y | Yes |

The variant protein has the following domains, as determined by using InterPro. The domains are described in Table 249:

TABLE 249

InterPro domain(s)

| InterPro ID | Domain description | Analysis type | Position(s) on protein |
|---|---|---|---|
| IPR001400 | Somatotropin hormone | FPrintScan | 161-177, 177-191, 61-74, 83-101 |
| IPR001400 | Somatotropin hormone | HMMPfam | 9-197 |
| IPR001400 | Somatotropin hormone | ScanRegExp | 61-94 |
| IPR001400 | Somatotropin hormone | ScanRegExp | 173-190 |

Variant protein HSGROW1_PEA_1_P7 is encoded by the following transcript(s): HSGROW1_PEA_1_T6. The coding portion of transcript HSGROW1_PEA_1_T6 starts at position 109 and ends at position 705. The transcript also has the following SNPs as listed in Table 250 (given according to their position on the nucleotide sequence, with the alternative nucleic acid listed; the last column indicates whether the SNP is known or not; the presence of known SNPs in variant protein HSGROW1_PEA_1_P7 sequence provides support for the deduced sequence of this variant protein according to the present invention).

TABLE 250

Nucleic acid SNPs

| SNP position on nucleotide sequence | Alternative nucleic acid | Previously known SNP? |
|---|---|---|
| 32 | C → A | Yes |
| 32 | C → G | Yes |

TABLE 250-continued

Nucleic acid SNPs

| SNP position on nucleotide sequence | Alternative nucleic acid | Previously known SNP? |
|---|---|---|
| 66 | C → G | No |
| 73 | C → | No |
| 142 | G → C | Yes |
| 142 | G → T | Yes |
| 284 | C → | No |
| 284 | C → T | No |
| 313 | C → A | No |
| 344 | C → | No |
| 358 | C → | No |
| 381 | C → | No |
| 381 | C → A | No |
| 425 | C → | No |
| 471 | C → | No |
| 471 | C → T | No |
| 629 | T → A | Yes |
| 629 | T → G | Yes |
| 675 | G → A | No |
| 750 | C → | No |
| 750 | C → T | Yes |
| 767 | C → | No |
| 767 | C → G | No |
| 772 | C → | No |
| 772 | C → T | No |
| 797 | → A | No |

Variant protein HSGROW1_PEA_1_P11 according to the present invention is encoded by transcript(s) HSGROW1_PEA_1_T10. An alignment is given to the known protein (Somatotropin precursor) in FIG. 185. A brief description of the relationship of the variant protein according to the present invention to each such aligned protein is as follows:

Comparison Report Between HSGROW1_PEA_1_µl and SOMA_HUMAN:

1. An isolated chimeric polypeptide HSGROW1_PEA_1_P11, comprising a first amino acid sequence being at least 90% homologous to MATGSRTSLLLAFGLLCLPWLQEG-SAFPTIPLSRLFDNAMLRAHRLHQLAFDT YQEFEE-AYIPKEQKYSFLQNPQTSLCFS-ESIPTPSNREETQQKSNLELLRISLLLI QSWLEPVQFLRSVFANSLVYGASDSNVY-DLLKDLEEGIQTLMG corresponding to amino acids 1-152 of SOMA_HUMAN, which also corresponds to amino acids 1-152 of HSGROW1_PEA_1_P11, and a second amino acid sequence being at least 70%, optionally at least 80%, preferably at least 85%, more preferably at least 90% and most preferably at least 95% homologous to a polypeptide having the sequence VRVAPGVPNPGAPLTLRAVLEKHCCPLF-SSQALTQENSPYSSFPLVNPPGLSLH PEGEGGK corresponding to amino acids 153-213 of HSGROW1_PEA_1_P11, wherein said first amino acid sequence and second amino acid sequence are contiguous and in a sequential order.

2. An isolated polypeptide for a tail of HSGROW1_PEA_1_P11, comprising a polypeptide being at least 70%, optionally at least about 80%, preferably at least about 85%, more preferably at least about 90% and most preferably at least about 95% homologous to the sequence VRVAPGVPNPGA-PLTLRAVLEKHCCPLF-SSQALTQENSPYSSFPLVNPPGLSLH PEGEGGK in HSGROW1_PEA_1_P11.

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure. Variant protein HSGROW1_PEA_1_P11 also has the following non-silent SNPs (Single Nucleotide Polymorphisms) as listed in Table 251, (given according to their position(s) on the amino acid sequence, with the alternative amino acid(s) listed; the last column indicates whether the SNP is known or not; the presence of known SNPs in variant protein HSGROW1_PEA_1_P11 sequence provides support for the deduced sequence of this variant protein according to the present invention).

TABLE 251

Amino acid mutations

| SNP position(s) on amino acid sequence | Alternative amino acid(s) | Previously known SNP? |
|---|---|---|
| 12 | A → P | Yes |
| 12 | A → S | Yes |
| 63 | P → | No |
| 77 | S → | No |
| 77 | S → F | No |
| 87 | P → T | No |
| 97 | S → | No |
| 102 | L → | No |
| 109 | I → | No |
| 124 | A → | No |
| 139 | L → | No |

The variant protein has the following domains, as determined by using InterPro. The domains are described in Table 252:

TABLE 252

InterPro domain(s)

| InterPro ID | Domain description | Analysis type | Position(s) on protein |
|---|---|---|---|
| IPR001400 | Somatotropin hormone | FPrintScan | 101-119, 79-92 |
| IPR001400 | Somatotropin hormone | HMMPfam | 9-176 |
| IPR001400 | Somatotropin hormone | ScanRegExp | 79-112 |

Variant protein HSGROW1_PEA_1_P11 is encoded by the following transcript(s): HSGROW1_PEA_1_T10. The coding portion of transcript HSGROW1_PEA_1_T10 starts at position 109 and ends at position 747. The transcript also has the following SNPs as listed in Table 253 (given according to their position on the nucleotide sequence, with the alternative nucleic acid listed; the last column indicates whether the SNP is known or not; the presence of known SNPs in variant protein HSGROW1_PEA_1_µl sequence provides support for the deduced sequence of this variant protein according to the present invention).

TABLE 253

Nucleic acid SNPs

| SNP position on nucleotide sequence | Alternative nucleic acid | Previously known SNP? |
|---|---|---|
| 32 | C → A | Yes |
| 32 | C → G | Yes |
| 66 | C → G | No |
| 73 | C → | No |
| 142 | G → C | Yes |
| 142 | G → T | Yes |
| 297 | A → | No |
| 297 | A → C | No |
| 338 | C → | No |
| 338 | C → T | No |
| 367 | C → A | No |
| 398 | C → | No |
| 412 | C → | No |
| 435 | C → | No |
| 435 | C → A | No |
| 479 | C → | No |
| 525 | C → | No |
| 525 | C → T | No |
| 936 | T → A | Yes |
| 936 | T → G | Yes |
| 982 | G → A | No |
| 1057 | C → | No |
| 1057 | C → T | Yes |
| 1074 | C → | No |
| 1074 | C → G | No |
| 1079 | C → | No |
| 1079 | C → T | No |
| 1104 | → A | No |

Variant protein HSGROW1_PEA_1_P12 according to the present invention is encoded by transcript(s) HSGROW1_PEA_1_T11. An alignment is given to the known protein (Somatotropin precursor) in FIG. 186. A brief description of the relationship of the variant protein according to the present invention to each such aligned protein is as follows:

Comparison Report Between HSGROW1_PEA_1_P12 and SOMA_HUMAN:

1. An isolated chimeric polypeptide HSGROW1_PEA_1_P12, comprising a first amino acid sequence being at least 90% homologous to MATGSRTSLLLAFGLLCLPWLQEG-SAFPTIPLSRLFDNAMLRAHRLHQLAFDT YQEFEE-AYIPKEQKYSFLQNPQTSLCFS-ESIPTPSNREETQQKSNLELLRISLLLI QSWLEPVQFLRSVFANSLVYGASDSNVY-DLLKDLEEGIQTLMG corresponding to amino acids 1-152 of SOMA_HUMAN, which also corresponds to amino acids 1-152 of HSGROW1_PEA_1_P12, and a second amino acid sequence being at least 70%, optionally at least 80%, preferably at least 85%, more preferably at least 90% and most preferably at least 95% homologous to a polypeptide having the sequence AGRWQPPDWADLQADLQQVRHKLTQR corresponding to amino acids 153-178 of HSGROW1_PEA_1_P12, wherein said first amino acid sequence and second amino acid sequence are contiguous and in a sequential order.

2. An isolated polypeptide for a tail of HSGROW1_PEA_1_P12, comprising a polypeptide being at least 70%, optionally at least about 80%, preferably at least about 85%, more preferably at least about 90% and most preferably at least about 95% homologous to the sequence AGRWQPPD-WADLQADLQQVRHKLTQR in HSGROW1_PEA_1_P12.

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure. Variant protein HSGROW1_PEA_1_P12 also has the following non-silent SNPs (Single Nucleotide Polymorphisms) as listed in Table 254, (given according to their position(s) on the amino acid sequence, with the alternative amino acid(s) listed; the last column indicates whether the SNP is known or not; the presence of known SNPs in variant protein HSGROW1_PEA_1_P12 sequence provides support for the deduced sequence of this variant protein according to the present invention).

TABLE 254

Amino acid mutations

| SNP position(s) on amino acid sequence | Alternative amino acid(s) | Previously known SNP? |
|---|---|---|
| 12 | A → P | Yes |
| 12 | A → S | Yes |
| 63 | P → | No |
| 77 | S → | No |
| 77 | S → F | No |
| 87 | P → T | No |
| 97 | S → | No |
| 102 | L → | No |
| 109 | I → | No |
| 124 | A → | No |
| 139 | L → | No |

The variant protein has the following domains, as determined by using InterPro. The domains are described in Table 255:

TABLE 255

InterPro domain(s)

| InterPro ID | Domain description | Analysis type | Position(s) on protein |
|---|---|---|---|
| IPR001400 | Somatotropin hormone | FPrintScan | 101-119, 79-92 |
| IPR001400 | Somatotropin hormone | HMMPfam | 9-178 |
| IPR001400 | Somatotropin hormone | ScanRegExp | 79-112 |

Variant protein HSGROW1_PEA_1_P12 is encoded by the following transcript(s): HSGROW1_PEA_1_T11. The coding portion of transcript HSGROW1_PEA_1_T11 starts at position 109 and ends at position 642. The transcript also has the following SNPs as listed in Table 256 (given according to their position on the nucleotide sequence, with the alternative nucleic acid listed; the last column indicates whether the SNP is known or not; the presence of known SNPs in variant protein HSGROW1_PEA_1_P12 sequence provides support for the deduced sequence of this variant protein according to the present invention).

TABLE 256

Nucleic acid SNPs

| SNP position on nucleotide sequence | Alternative nucleic acid | Previously known SNP? |
|---|---|---|
| 32 | C → A | Yes |
| 32 | C → G | Yes |
| 66 | C → G | No |
| 73 | C → | No |
| 142 | G → C | Yes |
| 142 | G → T | Yes |
| 297 | A → | No |
| 297 | A → C | No |
| 338 | C → | No |
| 338 | C → T | No |
| 367 | C → A | No |
| 398 | C → | No |
| 412 | C → | No |

TABLE 256-continued

Nucleic acid SNPs

| SNP position on nucleotide sequence | Alternative nucleic acid | Previously known SNP? |
|---|---|---|
| 435 | C → | No |
| 435 | C → A | No |
| 479 | C → | No |
| 525 | C → | No |
| 525 | C → T | No |
| 681 | T → A | Yes |
| 681 | T → G | Yes |
| 727 | G → A | No |
| 802 | C → | No |
| 802 | C → T | Yes |
| 819 | C → | No |
| 819 | C → G | No |
| 824 | C → | No |
| 824 | C → T | No |
| 849 | → A | No |

Variant protein HSGROW1_PEA_1_P18 according to the present invention is encoded by transcript(s) HSGROW1_PEA_1_T18. An alignment is given to the known protein (Somatotropin precursor) in FIG. 187. A brief description of the relationship of the variant protein according to the present invention to each such aligned protein is as follows:

Comparison Report Between HSGROW1_PEA_1_P18 and SOMA_HUMAN:

1. An isolated chimeric polypeptide HSGROW1_PEA_1_P18, comprising a first amino acid sequence being at least 90% homologous to MATGSRTSLLLAFGLLCLPWLQEGSAFPTIPLSRLFDNAMLRAHRLHQLAFDT YQEF corresponding to amino acids 1-57 of SOMA_HUMAN, which also corresponds to amino acids 1-57 of HSGROW1_PEA_1_P18, and a second amino acid sequence being at least 90% homologous to RLEDGSPRTGQIFKQTYSKFDTNSHNDDALLKNYGLLYCFRKDMDKVETFLR IVQCRSVEGSCGF corresponding to amino acids 153-217 of SOMA_HUMAN, which also corresponds to amino acids 58-122 of HSGROW1_PEA_1_P18, wherein said first amino acid sequence and second amino acid sequence are contiguous and in a sequential order.

2. An isolated chimeric polypeptide for an edge portion of HSGROW1_PEA_1_P18, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise FR, having a structure as follows: a sequence starting from any of amino acid numbers 57-x to 57; and ending at any of amino acid numbers 58+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure. Variant protein HSGROW1_PEA_1_P18 also has the following non-silent SNPs (Single Nucleotide Polymorphisms) as listed in Table 257, (given according to their position(s) on the amino acid sequence, with the alternative amino acid(s) listed; the last column indicates whether the SNP is known or not; the presence of known SNPs in variant protein HSGROW1_PEA_1_P18 sequence provides support for the deduced sequence of this variant protein according to the present invention).

TABLE 257

Amino acid mutations

| SNP position(s) on amino acid sequence | Alternative amino acid(s) | Previously known SNP? |
|---|---|---|
| 12 | A → P | Yes |
| 12 | A → S | Yes |
| 97 | F → C | Yes |
| 97 | F → Y | Yes |

The variant protein has the following domains, as determined by using InterPro. The domains are described in Table 258:

TABLE 258

InterPro domain(s)

| InterPro ID | Domain description | Analysis type | Position(s) on protein |
|---|---|---|---|
| IPR001400 | Somatotropin hormone | FPrintScan | 100-114, 84-100 |
| IPR001400 | Somatotropin hormone | HMMPfam | 9-120 |
| IPR001400 | Somatotropin hormone | ScanRegExp | 96-113 |

Variant protein HSGROW1_PEA_1_P18 is encoded by the following transcript(s): HSGROW1_PEA_1_T18. The coding portion of transcript HSGROW1_PEA_1_T18 starts at position 109 and ends at position 474. The transcript also has the following SNPs as listed in Table 259 (given according to their position on the nucleotide sequence, with the alternative nucleic acid listed; the last column indicates whether the SNP is known or not; the presence of known SNPs in variant protein HSGROW1_PEA_1_P18 sequence provides support for the deduced sequence of this variant protein according to the present invention).

TABLE 259

Nucleic acid SNPs

| SNP position on nucleotide sequence | Alternative nucleic acid | Previously known SNP? |
|---|---|---|
| 32 | C → A | Yes |
| 32 | C → G | Yes |
| 66 | C → G | No |
| 73 | C → | No |
| 142 | G → C | Yes |
| 142 | G → T | Yes |
| 398 | T → A | Yes |
| 398 | T → G | Yes |
| 444 | G → A | No |
| 519 | C → | No |
| 519 | C → T | Yes |
| 536 | C → | No |
| 536 | C → G | No |
| 541 | C → | No |
| 541 | C → T | No |
| 566 | → A | No |

Variant protein HSGROW1_PEA_1_P21 according to the present invention is encoded by transcript(s) HSGROW1_PEA_1_T12. An alignment is given to the known protein (Somatotropin precursor) in FIG. 188. A brief description of the relationship of the variant protein according to the present invention to each such aligned protein is as follows:

Comparison Report Between HSGROW1_PEA_1_P21 and SOMA_HUMAN:

1. An isolated chimeric polypeptide HSGROW1_PEA_1_P21, comprising a first amino acid sequence being at least 90% homologous to MATGSRTSLLLAFGLLCLPWLQEG-SAFPTIPLSRLFDNAMLRAHRLHQLAFDT YQEF corresponding to amino acids 1-57 of SOMA_HUMAN, which also corresponds to amino acids 1-57 of HSGROW1_PEA_1_P21, and a second amino acid sequence being at least 70%, optionally at least 80%, preferably at least 85%, more preferably at least 90% and most preferably at least 95% homologous to a polypeptide having the sequence PGVRRL corresponding to amino acids 58-63 of HSGROW1_PEA_1_P21, wherein said first amino acid sequence and second amino acid sequence are contiguous and in a sequential order.

2. An isolated polypeptide for a tail of HSGROW1_PEA_1_P21, comprising a polypeptide being at least 70%, optionally at least about 80%, preferably at least about 85%, more preferably at least about 90% and most preferably at least about 95% homologous to the sequence PGVRRL in HSGROW1_PEA_1_P21.

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure. Variant protein HSGROW1_PEA_1_P21 also has the following non-silent SNPs (Single Nucleotide Polymorphisms) as listed in Table 260, (given according to their position(s) on the amino acid sequence, with the alternative amino acid(s) listed; the last column indicates whether the SNP is known or not; the presence of known SNPs in variant protein HSGROW1_PEA_1_P21 sequence provides support for the deduced sequence of this variant protein according to the present invention).

TABLE 260

Amino acid mutations

| SNP position(s) on amino acid sequence | Alternative amino acid(s) | Previously known SNP? |
|---|---|---|
| 12 | A → P | Yes |
| 12 | A → S | Yes |

Variant protein HSGROW1_PEA_1_P21 is encoded by the following transcript(s): HSGROW1_PEA_1_T12. The coding portion of transcript HSGROW1_PEA_1_T12 starts at position 109 and ends at position 297. The transcript also has the following SNPs as listed in Table 261 (given according to their position on the nucleotide sequence, with the alternative nucleic acid listed; the last column indicates whether the SNP is known or not; the presence of known SNPs in variant protein HSGROW1_PEA_1_P21 sequence provides support for the deduced sequence of this variant protein according to the present invention).

TABLE 261

Nucleic acid SNPs

| SNP position on nucleotide sequence | Alternative nucleic acid | Previously known SNP? |
|---|---|---|
| 32 | C → A | Yes |
| 32 | C → G | Yes |
| 66 | C → G | No |
| 73 | C → | No |
| 142 | G → C | Yes |

TABLE 261-continued

Nucleic acid SNPs

| SNP position on nucleotide sequence | Alternative nucleic acid | Previously known SNP? |
|---|---|---|
| 142 | G → T | Yes |
| 319 | C → | No |
| 319 | C → T | No |
| 477 | T → A | Yes |
| 477 | T → G | Yes |
| 523 | G → A | No |
| 598 | C → | No |
| 598 | C → T | Yes |
| 615 | C → | No |
| 615 | C → G | No |
| 620 | C → | No |
| 620 | C → T | No |
| 645 | → A | No |

FIG. 202 depicts the domain structure of the variants described hereinabove in comparison to WT.

Example 58

Splice Variant of Pulmonary Surfactant-Associated Protein D Precursor

Background

Pulmonary surfactant covers the peripheral airway and consists of 90% lipid and 10% protein. The protein fraction contains 4 surfactant-associated proteins: SP-A and SP-D are glycoproteins which bind Collagen (i.e., collagenous proteins) and SP-B and SP-C are small hydrophobic proteins. Pulmonary surfactant contributes to the lung's defense against inhaled microorganisms.

Clinical Application

Surfactant deficiency has been implicated in various diseases. Adult Respiratory Distress Syndrome (ARDS) includes a large number of acute, diffuse infiltrative pulmonary lesions of differing etiology which are associated with a severe gas exchange disorder (in particular arterial hypoxemia). In ARDS, the lung surfactant malfunction can be caused by acute lung injury, diffuse pulmonary infections (e.g. due to viruses, bacteria, fungi), aspiration of, for example, gastric juice or in the case of near-drowning, inhalation of toxins or irritants (e.g. chlorine gas, nitrogen oxides, smoke), direct or indirect trauma (e.g. multiple fractures or pulmonary contusion), systemic reactions to inflammations outside the lung (e.g. hemorrhagic pancreatitis, gram-negative septicemia), transfusions of high blood volumes or alternatively after cardiopulmonary bypass.

In a similar, yet distinctive syndrome, Infant Respiratory Distress Syndrome (IRDS), the lung surfactant deficiency is caused by premature birth.

Surfactant abnormalities of differing severity are also reported for a number of other disease conditions, for example in obstructive pulmonary disorders such as asthma, bronchiolitis, COPD (Chronic Obstructive Pulmonary Disease) and after lung transplantation or alternatively after cardiopulmonary bypass. Macnaughton et al. (Chest 1994; 106: 421425) and DoCampo et al. (Lancet 1994; 343: 482) describe the administration of exogenous surfactant after cardiopulmonary bypass. McBrien et al. (Lancet 1993, 342: 1485-1486) and Suzuki et al. (Eur. J. Pediatr. 1996; 155: 383-384) describe the administration of surfactant after near-drowning. Struber et al. (Cardiovasc. Surg. 1995; 110; 563-564) describe the administration of surfactant after lung transplantation.

Presently, therapy of ARDS consists mainly in the earliest possible application of different forms of ventilation. However, it is known in the art, that surfactant preparations can be used in the treatment of IRDS or ARDS.

The Pulmonary Surfactant-Associated Protein D Precursor

The Pulmonary surfactant-associated protein D precursor (SP-D; PSP-D; GenBank Accession No. P35247; PSPD_HUMAN; PSPD; SFTP4; SFTPD) is an extracellular glycoprotein which binds maltose residues, mannose and other alpha-glucosyl moieties. It participates in the extracellular reorganization or turnover of pulmonary surfactant and involves in respiratory gaseous exchange and heterophilic cell adhesion.

Splice Variant D45608_T2 (SEQ ID NO:856) Encodes a New Form of the PSPD, D45608_P3 (SEQ ID NO:857)

The present inventors have uncovered a new PSPD variant [D45608_T2—SEQ ID NO:856; D45608_P3—SEQ ID NO:857]. The protein coordinates on the transcript start from nucleotide 172 and end at nucleotide 1179 as set forth in SEQ ID NO: 856.

Alignment of the new PSPD variant D45608_P3—SEQ ID NO:857) with the WT protein (GenBank Accession No. P35247; PSPD_HUMAN; SEQ ID NO:858) revealed that the new variant is missing amino acids 121-159 of the WT protein (GenBank Accession No. P35247; FIG. 205), thus creating a new edge SG for this protein. The new variant uncovered by the present invention lacks part of the Collagen-like domain (amino acids 46-222 of the WT protein; IPR008160 Collagen triple helix repeat).

Comparison Report Between D45608_P3 (SEQ ID NO:857) and PSPD_HUMAN (SEQ ID NO:858)

1. An isolated chimeric polypeptide D45608_P3, comprising a first amino acid sequence being at least 90% homologous to MLLFLLSALVLLTQPLGYLEAEMKTYSHRTMPSACTLVMCSSVESGLPGRDG RDGREGPRGEKGDPGLPGAAGQAG-MPGQAGPVGPKGDNGSVGEPGPKGDT GPS corresponding to amino acids 1-105 of PSPD_HUMAN, which also corresponds to amino acids 1-105 of D45608_P3, and a second amino acid sequence being at least 90% homologous to GEVGAPGMQGSAGARGLAGP-KGERGVPGERGVPGNTGAAGSAGAMGPQGS PGARGPPGLKGDKGIPGDKGAKGESGLP-DVASLRQQVEALQGQVQHLQAAF SQYKKVELFP-NGQSVGEKIFKTAGFVK-PFTEAQLLCTQAGGQLASPRSAAEN AALQQLVVAKNEAAFLSMTDSKTEGK-FTYPTGESLVYSNWAPGEPNDDGGS EDCVEIFTNGK-WNDRACGEKRLVVCEF corresponding to amino acids 145-375 of PSPD_HUMAN, which also corresponds to amino acids 106-336 of D45608_P3, wherein said first amino acid sequence and second amino acid sequence are contiguous and in a sequential order.

2. An isolated chimeric edge portion of D45608_P3, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise SG, having a structure as follows: a sequence starting from any of amino acid numbers 105-x to 105; and ending at any of amino acid numbers 106+((n−2)−x), in which x varies from 0 to n−2.

Clinical Applications of the New PSDS Variant

The new PSDS variant of the present invention D45608_P3 (SEQ ID NO:857), can be used as either a diagnostic marker for surfactant destruction in various clinical conditions such as acute lung injury, diffuse pulmonary infections (e.g. due to viruses, bacteria, fungi), aspiration of gastric juice, inhalation of toxins or irritants (e.g. chlorine gas, nitrogen oxides, smoke), a trauma (e.g. multiple fractures or pulmonary contusion), systemic reactions to inflammations outside the lung (e.g. hemorrhagic pancreatitis, gram-negative septicemia), transfusions of high blood volumes or alternatively after cardiopulmonary bypass, Infant Respiratory Distress Syndrome (IRDS) and/or Adult Respiratory Distress Syndrome (ARDS). Alternatively or additionally, the new PSPD variant uncovered by the present inventors can be used in the treatment of any of the diseases, disorders or conditions described hereinabove.

Thus, the present inventors have uncovered a therapeutic agent, a polypeptide homologous to SEQ ID NO:857 and/or an expressible polynucleotide homologous to SEQ ID NO:856 which can be used to treat a surfactant deficiency—related disease, disorder of condition, e.g., acute lung injury, diffuse pulmonary infections (e.g. due to viruses, bacteria, fungi), aspiration of gastric juice, inhalation of toxins or irritants (e.g. chlorine gas, nitrogen oxides, smoke), a trauma (e.g. multiple fractures or pulmonary contusion), systemic reactions to inflammations outside the lung (e.g. hemorrhagic pancreatitis, gram-negative septicemia), transfusions of high blood volumes or alternatively after cardiopulmonary bypass, Infant Respiratory Distress Syndrome (IRDS) and/or Adult Respiratory Distress Syndrome (ARDS).

It will be appreciated that such an agent can be administered or provided to an individual in need thereof per se or as part of a pharmaceutical composition with a pharmaceutical acceptable carrier (e.g., PEG and liposomes).

While further reducing the present invention to practice, these results suggest the use of the new PSDS variant of the present invention (SEQ ID NO:857), the polynucleotide encoding same (SEQ ID NO:856) as a diagnostic marker for a surfactant deficiency—related disease as described hereinabove. Diagnosis according to this aspect of the present invention is effected using immunological assays [e.g., Western Blot, immunohistochemistry, FACS analysis, radio immuno assay (RIA), immunofluorescence, and the like using an antibody directed against the PSDS variant (SEQ ID NO:857)], or by nucleic acid techniques (NAT) such as RT-PCR, Northern Blot, in situ hybridization, in situ RT-PCR.

Example 59

Description for Cluster HUMTNFRII

Cluster HUMTNFRII features 6 transcript(s) and 19 segment(s) of interest, the names for which are given in Tables 262 and 263, respectively. The selected protein variants are given in table 264.

TABLE 262

Transcripts of interest

| Transcript Name | SEQ ID NO: |
|---|---|
| HUMTNFRII_PEA_1_T4 | 138 |
| HUMTNFRII_PEA_1_T7 | 332 |
| HUMTNFRII_PEA_1_T8 | 333 |
| HUMTNFRII_PEA_1_T9 | 370 |

TABLE 262-continued

Transcripts of interest

| Transcript Name | SEQ ID NO: |
|---|---|
| HUMTNFRII_PEA_1_T10 | 675 |
| HUMTNFRII_PEA_1_T11 | 676 |

TABLE 263

Segments of interest

| Segment Name | SEQ ID NO: |
|---|---|
| HUMTNFRII_PEA_1_node_0 | 677 |
| HUMTNFRII_PEA_1_node_8 | 678 |
| HUMTNFRII_PEA_1_node_15 | 679 |
| HUMTNFRII_PEA_1_node_18 | 680 |
| HUMTNFRII_PEA_1_node_32 | 681 |
| HUMTNFRII_PEA_1_node_37 | 682 |
| HUMTNFRII_PEA_1_node_38 | 683 |
| HUMTNFRII_PEA_1_node_39 | 684 |
| HUMTNFRII_PEA_1_node_40 | 685 |
| HUMTNFRII_PEA_1_node_12 | 686 |
| HUMTNFRII_PEA_1_node_17 | 687 |
| HUMTNFRII_PEA_1_node_20 | 688 |
| HUMTNFRII_PEA_1_node_21 | 689 |
| HUMTNFRII_PEA_1_node_23 | 690 |
| HUMTNFRII_PEA_1_node_24 | 691 |
| HUMTNFRII_PEA_1_node_25 | 692 |
| HUMTNFRII_PEA_1_node_27 | 693 |
| HUMTNFRII_PEA_1_node_28 | 694 |
| HUMTNFRII_PEA_1_node_30 | 695 |

TABLE 264

Proteins of interest

| Protein Name | SEQ ID NO: | Corresponding Transcript(s) |
|---|---|---|
| HUMTNFRII_PEA_1_P7 | 696 | HUMTNFRII_PEA_1_T11 |
| HUMTNFRII_PEA_1_P15 | 697 | HUMTNFRII_PEA_1_T4 |
| HUMTNFRII_PEA_1_P16 | 698 | HUMTNFRII_PEA_1_T7 |
| HUMTNFRII_PEA_1_P17 | 699 | HUMTNFRII_PEA_1_T8 |
| HUMTNFRII_PEA_1_P18 | 860 | HUMTNFRII_PEA_1_T9 |
| HUMTNFRII_PEA_1_P19 | 861 | HUMTNFRII_PEA_1_T10 |

These sequences are variants of the known protein Tumor necrosis factor receptor superfamily member 1B precursor (SwissProt accession identifier TR1B_HUMAN; known also according to the synonyms Tumor necrosis factor receptor 2; p80; TNF-R2; p75; CD120b; Etanercept; TBPII), referred to herein as the previously known protein.

Protein Tumor necrosis factor receptor superfamily member 1B precursor is known or believed to have the following function(s): Receptor with high affinity for TNFSF2/TNF-alpha and approximately 5-fold lower affinity for homotrimeric TNFSF1/lymphotoxin-alpha. The TRAF1/TRAF2 complex recruits the apoptotic suppressors BIRC2 and BIRC3 to TNFRSF1B/TNFR2. The TNF receptor 2 mediates most of the metabolic effects of TNF-alpha. The sequence for protein Tumor necrosis factor receptor superfamily member 1B precursor is given in SEQ ID NO:862, as "Tumor necrosis factor receptor superfamily member 1B precursor amino acid sequence". Known polymorphisms for this sequence are as shown in Table 265.

TABLE 265

Amino acid mutations for Known Protein

| SNP position(s) on amino acid sequence | Comment |
|---|---|
| 187 | V → M (in dbSNP: 5746025)./FTId = VAR_017176. |
| 196 | M → R (frequent polymorphism; seems to be associated with hyperandrogenism, polycystic ovary syndrome (PCOS) and systemic lupus erythematosus; dbSNP: 1061622)./FTId = VAR_015434. |
| 232 | E → K (in dbSNP: 5746026)./FTId = VAR_015435. |
| 236 | A → T (in dbSNP: 5746027)./FTId = VAR_017177. |
| 264 | L → P (in dbSNP: 5746031)./FTId = VAR_017178. |
| 269 | T → P./FTId = VAR_017179. |
| 295 | Q → R (in dbSNP: 5746032)./FTId = VAR_017180. |
| 301 | P → R./FTId = VAR_017181. |
| 141 | R → P |
| 363 | A → T |

Protein Tumor necrosis factor receptor superfamily member 1B precursor localization is believed to be Type I membrane protein and secreted.

The following GO Annotation(s) apply to the previously known protein. The following annotation(s) were found: apoptosis, which are annotation(s) related to Biological Process; receptor; tumor necrosis factor receptor, which are annotation(s) related to Molecular Function; and integral membrane protein, which are annotation(s) related to Cellular Component.

The GO assignment relies on information from one or more of the SwissProt/TremB1 Protein knowledgebaseor Locuslink.

TNFR1B is a receptor with high affinity for TNF-alpha lymphotoxin-alpha and mediates most of the metabolic effects of TNF-alpha. It is strongly expressed on stimulated T and B lymphocytes. TNFR2 is the main TNF receptor found on circulating T cells and is the major mediator of autoregulatory apoptosis in CD8+ cells. It is a type I membrane protein (isoform 1); secreted (isoform 2 and TBP-II). A soluble form (tumor necrosis factor binding protein 2) is produced from the membrane form by proteolytic processing. Isoform 2 blocks TNF-alpha-induced apoptosis. One currently available therapeutic based on this protein is Enbrel (Immunex and Wyeth-Ayerst), which is used to treat moderate to servere rheumatoid arthritis (RA).

As noted above, cluster HUMTNFRII features 6 transcript(s), which were listed in Table 262 above. These transcript(s) encode for protein(s) which are variant(s) of protein Tumor necrosis factor receptor superfamily member 1B precursor. A description of each variant protein according to the present invention is now provided.

Variant protein HUMTNFRII_PEA_1_P7 according to the present invention is encoded by transcript(s) HUMTNFRII_PEA_1_T11. An alignment is given to the known protein (Tumor necrosis factor receptor superfamily member 1B precursor) in FIG. 206. One or more alignments to one or more previously published protein sequences are given in FIGS. 207-210. A brief description of the relationship of the variant protein according to the present invention to each such aligned protein is as follows:

Comparison Report Between HUMTNFRII_PEA_1_P7 and TR1B_HUMAN:

1. An isolated chimeric polypeptide HUMTNFRII_PEA_1_P7, comprising a first amino acid sequence being at least 90% homologous to MAPVAVWAALAVGLELWAAA-HALPAQVAFTPYAPEPGSTCRLREYYDQTA QMCCSKCSPGQHAKVFCTKTSDTVCD-SCEDSTYTQLWNWVPECLSCGSRCSS DQVETQAC-TREQNRICTCRPGWYCALSKQEGCRLCA-PLRKCRPGFGVARPGT ETSDVVCKPCAPGTFSNTTSSTDICRPH-QICNVVAIPGNASMDAVCTSTSPTRS MAP-GAVHLPQPVSTRSQHTQPTPEP-STAPSTSFLLPMGPSPPAEGSTGDFALPV corresponding to amino acids 1-262 of TR1B_HUMAN, which also corresponds to amino acids 1-262 of HUMTNFRII_PEA_1_P7, and a second amino acid sequence being at least 90% homologous to DSSPGGHGTQVNVTCIVNVCSSSDH-SSQCSSQASSTMGDTDSSPSESPKDEQV PFSKEE-CAFRSQLETPETLLGSTEEKPLPLGVPDAGMKPS corresponding to amino acids 369-461 of TR1B_HUMAN, which also corresponds to amino acids 263-355 of HUMTNFRII_PEA_1_P7, wherein said first amino acid sequence and second amino acid sequence are contiguous and in a sequential order.

2. An isolated chimeric edge portion of HUMTNFRII_PEA_1_P7, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise VD, having a structure as follows: a sequence starting from any of amino acid numbers 262-x to 262; and ending at any of amino acid numbers 263+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTNFRII_PEA_1_P7 also has the following non-silent SNPs (Single Nucleotide Polymorphisms) as listed in Table 266, (given according to their position(s) on the amino acid sequence, with the alternative amino acid(s) listed; the last column indicates whether the SNP is known or not; the presence of known SNPs in variant protein HUMTNFRII_PEA_1_P7 sequence provides support for the deduced sequence of this variant protein according to the present invention).

TABLE 266

Amino acid mutations

| SNP position(s) on amino acid sequence | Alternative amino acid(s) | Previously known SNP? |
| --- | --- | --- |
| 25 | A → | No |
| 47 | D → G | No |
| 61 | Q → R | No |
| 81 | S → G | No |
| 116 | R → H | No |
| 119 | T → A | No |
| 153 | G → E | No |
| 171 | N → | No |
| 187 | V → M | Yes |
| 196 | M → | No |
| 196 | M → R | Yes |
| 232 | E → K | Yes |
| 236 | A → T | Yes |
| 243 | L → | No |
| 254 | S → C | No |
| 259 | A → V | No |
| 296 | S → N | No |
| 333 | T → | No |
| 342 | P → H | No |
| 342 | P → | No |

The glycosylation sites of variant protein HUMTNFRII_PEA_1_P7, as compared to the known protein Tumor necrosis factor receptor superfamily member 1B precursor, are described in Table 267 (given according to their position(s) on the amino acid sequence in the first column; the second column indicates whether the glycosylation site is present in the variant protein; and the last column indicates whether the position is different on the variant protein).

TABLE 267

Glycosylation site(s)

| Position(s) on known amino acid sequence | Present in variant protein? | Position in variant protein? |
| --- | --- | --- |
| 171 | yes | 171 |
| 193 | yes | 193 |

The variant protein has the following domains, as determined by using InterPro. The domains are described in Table 268:

TABLE 268

InterPro domain(s)

| InterPro ID | Domain description | Analysis type | Position(s) on protein |
| --- | --- | --- | --- |
| IPR001368 | TNFR/CD27/30/40/95 cysteine-rich region | HMMPfam | 40-75, 78-118 |
| IPR001368 | TNFR/CD27/30/40/95 cysteine-rich region | HMMSmart | 120-161, 164-200, 40-75, 78-118 |
| IPR001368 | TNFR/CD27/30/40/95 cysteine-rich region | ScanRegExp | 40-75, 78-118 |
| IPR001368 | TNFR/CD27/30/40/95 cysteine-rich region | ProfileScan | 119-161, 39-75, 77-118 |

Variant protein HUMTNFRII_PEA_1_P7 is encoded by the following transcript(s): HUMTNFRII_PEA_1_T11. The coding portion of transcript HUMTNFRII_PEA_1_T11 starts at position 108 and ends at position 1172. The transcript also has the following SNPs as listed in Table 269 (given according to their position on the nucleotide sequence, with the alternative nucleic acid listed; the last column indicates whether the SNP is known or not; the presence of known SNPs in variant protein HUMTNFRII_PEA_1_P7 sequence provides support for the deduced sequence of this variant protein according to the present invention).

TABLE 269

Nucleic acid SNPs

| SNP position on nucleotide sequence | Alternative nucleic acid | Previously known SNP? |
| --- | --- | --- |
| 33 | G → T | Yes |
| 49 | C → T | Yes |
| 181 | C → | No |
| 247 | A → G | No |
| 275 | A → G | Yes |
| 289 | A → G | No |
| 290 | A → G | No |
| 348 | A → G | No |
| 454 | G → A | No |
| 462 | A → G | No |
| 565 | G → A | No |
| 604 | → C | No |
| 604 | → G | No |
| 618 | A → | No |
| 650 | C → T | Yes |
| 666 | G → A | Yes |
| 694 | T → | No |
| 694 | T → G | Yes |
| 801 | G → A | Yes |
| 813 | G → A | Yes |
| 815 | T → C | No |
| 836 | C → | No |
| 867 | A → T | No |
| 883 | C → T | No |
| 994 | G → A | No |
| 1105 | C → | No |
| 1131 | C → | No |
| 1132 | C → | No |
| 1132 | C → A | No |
| 1188 | G → A | No |
| 1189 | G → A | No |
| 1189 | G → C | No |
| 1363 | G → A | Yes |
| 1368 | T → G | Yes |
| 1390 | T → C | Yes |
| 1495 | C → T | No |
| 1548 | C → | No |
| 1562 | C → A | Yes |
| 1600 | C → T | Yes |

TABLE 269-continued

Nucleic acid SNPs

| SNP position on nucleotide sequence | Alternative nucleic acid | Previously known SNP? |
|---|---|---|
| 1628 | A → G | Yes |
| 1647 | T → C | Yes |
| 1653 | C → G | Yes |
| 1835 | C → T | Yes |
| 2013 | C → G | Yes |
| 2069 | → A | No |
| 2097 | C → T | Yes |
| 2255 | C → T | Yes |
| 2347 | C → T | No |
| 2352 | C → T | Yes |
| 2440 | C → T | Yes |
| 2593 | T → C | Yes |
| 2597 | G → A | Yes |
| 2669 | A → G | Yes |
| 2728 | C → A | Yes |
| 2735 | C → T | Yes |
| 2819 | G → A | Yes |
| 2935 | G → A | Yes |

Variant protein HUMTNFRII_PEA_1_P15 according to the present invention is encoded by transcript(s) HUMTN-FRII_PEA_1_T4. An alignment is given to the known protein (Tumor necrosis factor receptor superfamily member 1B precursor) in FIG. 207. One or more alignments to one or more previously published protein sequences are given in FIGS. 206, and 208-210. A brief description of the relationship of the variant protein according to the present invention to each such aligned protein is as follows:

Comparison Report Between HUMTNFRII_PEA_1_P15 and TR1B_HUMAN:

1. An isolated chimeric polypeptide HUMTNFRII_PEA_1_P15, comprising a first amino acid sequence being at least 90% homologous to MAPVAVWAALAVGLELWAAA-HALPAQ corresponding to amino acids 1-26 of TR1B_HUMAN, which also corresponds to amino acids 1-26 of HUMTNFRII_PEA_1_P15, and a second amino acid sequence being at least 70%, optionally at least 80%, preferably at least 85%, more preferably at least 90% and most preferably at least 95% homologous to a polypeptide having the sequence GFAAH corresponding to amino acids 27-31 of HUMTNFRII_PEA_1_P15, wherein said first amino acid sequence and second amino acid sequence are contiguous and in a sequential order.

2. An isolated polypeptide for a tail of HUMTNFRII_PEA_1_P15, comprising a polypeptide being at least 70%, optionally at least about 80%, preferably at least about 85%, more preferably at least about 90% and most preferably at least about 95% homologous to the sequence GFAAH in HUMTNFRII_PEA_1_P15.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTNFRII_PEA_1_P15 also has the following non-silent SNPs (Single Nucleotide Polymorphisms) as listed in Table 270, (given according to their position(s) on the amino acid sequence, with the alternative amino acid(s) listed; the last column indicates whether the SNP is known or not; the presence of known SNPs in variant protein HUMTNFRII_PEA_1_P15 sequence provides support for the deduced sequence of this variant protein according to the present invention).

TABLE 270

Amino acid mutations

| SNP position(s) on amino acid sequence | Alternative amino acid(s) | Previously known SNP? |
|---|---|---|
| 25 | A → | No |

The glycosylation sites of variant protein HUMTNFRII_PEA_1_P15, as compared to the known protein Tumor necrosis factor receptor superfamily member 1B precursor, are described in Table 271 (given according to their position(s) on the amino acid sequence in the first column; the second column indicates whether the glycosylation site is present in the variant protein; and the last column indicates whether the position is different on the variant protein).

TABLE 271

Glycosylation site(s)

| Position(s) on known amino acid sequence | Present in variant protein? | Position in variant protein? |
|---|---|---|
| 171 | no | |
| 193 | no | |

Variant protein HUMTNFRII_PEA_1_P15 is encoded by the following transcript(s): HUMTNFRII_PEA_1_T4. The coding portion of transcript HUMTNFRII_PEA_1_T4 starts at position 108 and ends at position 200. The transcript also has the following SNPs as listed in Table 272 (given according to their position on the nucleotide sequence, with the alternative nucleic acid listed; the last column indicates whether the SNP is known or not; the presence of known SNPs in variant protein HUMTNFRII_PEA_1_P15 sequence provides support for the deduced sequence of this variant protein according to the present invention).

TABLE 272

Nucleic acid SNPs

| SNP position on nucleotide sequence | Alternative nucleic acid | Previously known SNP? |
|---|---|---|
| 33 | G → T | Yes |
| 49 | C → T | Yes |
| 181 | C → | No |
| 421 | A → G | No |
| 449 | A → G | Yes |
| 463 | A → G | No |
| 464 | A → G | No |
| 522 | A → G | No |
| 628 | G → A | No |
| 636 | A → G | No |
| 739 | G → A | No |
| 778 | → C | No |
| 778 | → G | No |
| 792 | A → | No |
| 824 | C → T | Yes |
| 840 | G → A | Yes |
| 868 | T → | No |
| 868 | T → G | Yes |
| 975 | G → A | Yes |
| 987 | G → A | Yes |
| 989 | T → C | No |

TABLE 272-continued

Nucleic acid SNPs

| SNP position on nucleotide sequence | Alternative nucleic acid | Previously known SNP? |
|---|---|---|
| 1010 | C → | No |
| 1041 | A → T | No |
| 1057 | C → T | No |
| 1072 | T → C | Yes |
| 1122 | T → C | No |
| 1124 | T → | No |
| 1124 | T → C | No |
| 1165 | A → G | Yes |
| 1184 | T → C | No |
| 1195 | C → T | No |
| 1206 | C → T | No |
| 1270 | C → | No |
| 1365 | → A | No |
| 1365 | → G | No |
| 1366 | G → A | No |
| 1486 | G → A | No |
| 1597 | C → | No |
| 1623 | C → | No |
| 1624 | C → | No |
| 1624 | C → A | No |
| 1680 | G → A | No |
| 1681 | G → A | No |
| 1681 | G → C | No |
| 1855 | G → A | Yes |
| 1860 | T → G | Yes |
| 1882 | T → C | Yes |
| 1987 | C → T | No |
| 2040 | C → | No |
| 2054 | C → A | Yes |
| 2092 | C → T | Yes |
| 2120 | A → G | Yes |
| 2139 | T → C | Yes |
| 2145 | C → G | Yes |
| 2327 | C → T | Yes |
| 2505 | C → G | Yes |
| 2561 | → A | No |
| 2589 | C → T | Yes |
| 2747 | C → T | Yes |
| 2839 | C → T | No |
| 2844 | C → T | Yes |
| 2932 | C → T | Yes |
| 3085 | T → C | Yes |
| 3089 | G → A | Yes |
| 3161 | A → G | Yes |
| 3220 | C → A | Yes |
| 3227 | C → T | Yes |
| 3311 | G → A | Yes |
| 3427 | G → A | Yes |

Variant protein HUMTNFRII_PEA_1_P16 according to the present invention is encoded by transcript(s) HUMTNFRII_PEA_1_T7. The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTNFRII_PEA_1_P16 also has the following non-silent SNPs (Single Nucleotide Polymorphisms) as listed in Table 273, (given according to their position(s) on the amino acid sequence, with the alternative amino acid(s) listed; the last column indicates whether the SNP is known or not; the presence of known SNPs in variant protein HUMTNFRII_PEA_1_P16 sequence provides support for the deduced sequence of this variant protein according to the present invention).

TABLE 273

Amino acid mutations

| SNP position(s) on amino acid sequence | Alternative amino acid(s) | Previously known SNP? |
|---|---|---|
| 25 | A → | No |
| 28 | N → D | No |
| 28 | N → S | No |

Variant protein HUMTNFRII_PEA_1_P16 is encoded by the following transcript(s): HUMTNFRII_PEA_1_T7. The coding portion of transcript HUMTNFRII_PEA_1_T7 starts at position 108 and ends at position 287. The transcript also has the following SNPs as listed in Table 274 (given according to their position on the nucleotide sequence, with the alternative nucleic acid listed; the last column indicates whether the SNP is known or not; the presence of known SNPs in variant protein HUMTNFRII_PEA_1_P16 sequence provides support for the deduced sequence of this variant protein according to the present invention).

TABLE 274

Nucleic acid SNPs

| SNP position on nucleotide sequence | Alternative nucleic acid | Previously known SNP? |
|---|---|---|
| 33 | G → T | Yes |
| 49 | C → T | Yes |
| 181 | C → | No |
| 189 | A → G | No |
| 190 | A → G | No |
| 248 | A → G | No |
| 354 | G → A | No |
| 362 | A → G | No |
| 465 | G → A | No |
| 504 | → C | No |
| 504 | → G | No |
| 518 | A → | No |
| 550 | C → T | Yes |
| 566 | G → A | Yes |
| 594 | T → | No |
| 594 | T → G | Yes |
| 701 | G → A | Yes |
| 713 | G → A | Yes |
| 715 | T → C | No |
| 736 | C → | No |
| 767 | A → T | No |
| 783 | C → T | No |
| 798 | T → C | Yes |
| 848 | T → C | No |
| 850 | T → | No |
| 850 | T → C | No |
| 891 | A → G | Yes |
| 910 | T → C | No |
| 921 | C → T | No |
| 932 | C → T | No |
| 996 | C → | No |
| 1091 | → A | No |
| 1091 | → G | No |
| 1092 | G → A | No |
| 1212 | G → A | No |
| 1323 | C → | No |
| 1349 | C → | No |
| 1350 | C → | No |
| 1350 | C → A | No |
| 1406 | G → A | No |
| 1407 | G → A | No |
| 1407 | G → C | No |
| 1581 | G → A | Yes |
| 1586 | T → G | Yes |
| 1608 | T → C | Yes |
| 1713 | C → T | No |
| 1766 | C → | No |
| 1780 | C → A | Yes |

TABLE 274-continued

Nucleic acid SNPs

| SNP position on nucleotide sequence | Alternative nucleic acid | Previously known SNP? |
|---|---|---|
| 1818 | C → T | Yes |
| 1846 | A → G | Yes |
| 1865 | T → C | Yes |
| 1871 | C → G | Yes |
| 2053 | C → T | Yes |
| 2231 | C → G | Yes |
| 2287 | → A | No |
| 2315 | C → T | Yes |
| 2473 | C → T | Yes |
| 2565 | C → T | No |
| 2570 | C → T | Yes |
| 2658 | C → T | Yes |
| 2811 | T → C | Yes |
| 2815 | G → A | Yes |
| 2887 | A → G | Yes |
| 2946 | C → A | Yes |
| 2953 | C → T | Yes |
| 3037 | G → A | Yes |
| 3153 | G → A | Yes |

Variant protein HUMTNFRII_PEA_1_P17 according to the present invention is encoded by transcript(s) HUMTNFRII_PEA_1_T8. An alignment is given to the known protein (Tumor necrosis factor receptor superfamily member 1B precursor) in FIG. 208. One or more alignments to one or more previously published protein sequences are given in FIGS. 206-207 and 209-210. A brief description of the relationship of the variant protein according to the present invention to each such aligned protein is as follows:

Comparison Report Between HUMTNFRII_PEA_1_P17 and TR1B_HUMAN (SEQ ID NO:862):

1. An isolated chimeric polypeptide HUMTNFRII_PEA_1_P17, comprising a first amino acid sequence being at least 90% homologous to MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSS DQVETQACTREQNRICTCRPGWYCALSKQEGCRLCAPLRKCRPGFGVARP corresponding to amino acids 1-152 of TR1B_HUMAN, which also corresponds to amino acids 1-152 of HUMTNFRII_PEA_1_P17, and a second amino acid sequence being at least 70%, optionally at least 80%, preferably at least 85%, more preferably at least 90% and most preferably at least 95% homologous to a polypeptide having the sequence DLS corresponding to amino acids 153-155 of HUMTNFRII_PEA_1_P17, wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTNFRII_PEA_1_P17 also has the following non-silent SNPs (Single Nucleotide Polymorphisms) as listed in Table 275, (given according to their position(s) on the amino acid sequence, with the alternative amino acid(s) listed; the last column indicates whether the SNP is known or not; the presence of known SNPs in variant protein HUMTNFRII_PEA_1_P17 sequence provides support for the deduced sequence of this variant protein according to the present invention).

TABLE 275

Amino acid mutations

| SNP position(s) on amino acid sequence | Alternative amino acid(s) | Previously known SNP? |
|---|---|---|
| 25 | A → | No |
| 47 | D → G | No |
| 61 | Q → R | No |
| 81 | S → G | No |
| 116 | R → H | No |
| 119 | T → A | No |

The glycosylation sites of variant protein HUMTNFRII_PEA_1_P17, as compared to the known protein Tumor necrosis factor receptor superfamily member 1B precursor, are described in Table 276 (given according to their position(s) on the amino acid sequence in the first column; the second column indicates whether the glycosylation site is present in the variant protein; and the last column indicates whether the position is different on the variant protein).

TABLE 276

Glycosylation site(s)

| Position(s) on known amino acid sequence | Present in variant protein? | Position in variant protein? |
|---|---|---|
| 171 | no | |
| 193 | no | |

The variant protein has the following domains, as determined by using InterPro. The domains are described in Table 277:

TABLE 277

InterPro domain(s)

| InterPro ID | Domain description | Analysis type | Position(s) on protein |
|---|---|---|---|
| IPR001368 | TNFR/CD27/30/40/95 cysteine-rich region | HMMPfam | 40-75, 78-118 |
| IPR001368 | TNFR/CD27/30/40/95 cysteine-rich region | HMMSmart | 120-155, 40-75, 78-118 |
| IPR001368 | TNFR/CD27/30/40/95 cysteine-rich region | ScanRegExp | 40-75, 78-118 |
| IPR001368 | TNFR/CD27/30/40/95 cysteine-rich region | ProfileScan | 39-75, 77-118 |

Variant protein HUMTNFRII_PEA_1_P17 is encoded by the following transcript(s): HUMTNFRII_PEA_1_T8. The coding portion of transcript HUMTNFRII_PEA_1_T8 starts at position 108 and ends at position 572. The transcript also has the following SNPs as listed in Table 278 (given according to their position on the nucleotide sequence, with the alternative nucleic acid listed; the last column indicates whether the SNP is known or not; the presence of known SNPs in variant protein HUMTNFRII_PEA_1_P17 sequence provides support for the deduced sequence of this variant protein according to the present invention).

TABLE 278

Nucleic acid SNPs

| SNP position on nucleotide sequence | Alternative nucleic acid | Previously known SNP? |
|---|---|---|
| 33 | G → T | Yes |
| 49 | C → T | Yes |
| 181 | C → | No |
| 247 | A → G | No |
| 275 | A → G | Yes |
| 289 | A → G | No |
| 290 | A → G | No |
| 348 | A → G | No |
| 454 | G → A | No |
| 462 | A → G | No |
| 648 | G → A | No |
| 687 | → C | No |
| 687 | → G | No |
| 701 | A → | No |
| 733 | C → T | Yes |
| 749 | G → A | Yes |
| 777 | T → | No |
| 777 | T → G | Yes |
| 884 | G → A | Yes |
| 896 | G → A | Yes |
| 898 | T → C | No |
| 919 | C → | No |
| 950 | A → T | No |
| 966 | C → T | No |
| 981 | T → C | Yes |
| 1031 | T → C | No |
| 1033 | T → | No |
| 1033 | T → C | No |
| 1074 | A → G | Yes |
| 1093 | T → C | No |
| 1104 | C → T | No |
| 1115 | C → T | No |
| 1179 | C → | No |
| 1274 | → A | No |
| 1274 | → G | No |
| 1275 | G → A | No |
| 1395 | G → A | No |
| 1506 | C → | No |
| 1532 | C → | No |
| 1533 | C → | No |
| 1533 | C → A | No |
| 1589 | G → A | No |
| 1590 | G → A | No |
| 1590 | G → C | No |
| 1764 | G → A | Yes |
| 1769 | T → G | Yes |
| 1791 | T → C | Yes |
| 1896 | C → T | No |
| 1949 | C → | No |
| 1963 | C → A | Yes |
| 2001 | C → T | Yes |
| 2029 | A → G | Yes |
| 2048 | T → C | Yes |
| 2054 | C → G | Yes |
| 2236 | C → T | Yes |
| 2414 | C → G | Yes |
| 2470 | → A | No |
| 2498 | C → T | Yes |
| 2656 | C → T | Yes |
| 2748 | C → T | No |
| 2753 | C → T | Yes |
| 2841 | C → T | Yes |
| 2994 | T → C | Yes |
| 2998 | G → A | Yes |
| 3070 | A → G | Yes |
| 3129 | C → A | Yes |
| 3136 | C → T | Yes |
| 3220 | G → A | Yes |
| 3336 | G → A | Yes |

Variant protein HUMTNFRII_PEA_1_P18 according to the present invention is encoded by transcript(s) HUMTNFRII_PEA_1_T9. An alignment is given to the known protein (Tumor necrosis factor receptor superfamily member 1B precursor) in FIG. 209. One or more alignments to one or more previously published protein sequences are given in FIGS. 206-208 and 210. A brief description of the relationship of the variant protein according to the present invention to each such aligned protein is as follows:

Comparison Report Between HUMTNFRII_PEA_1_P18 and TR1B_HUMAN:

1. An isolated chimeric polypeptide HUMTNFRII_1_P18, comprising a first amino acid sequence being at least 90% homologous to MAPVAVWAALAVGLELWAAA-HALPAQVAFTPYAPEPGSTCRLREYYDQTA QMCCSKCSPGQHAKVFCTKTSDTVCD-SCEDSTYTQLWNWVPECLSCGSRCSS corresponding to amino acids 1-102 of TR1B_HUMAN, which also corresponds to amino acids 1-102 of HUMTNFRII_PEA_1_P18, and a second amino acid sequence being at least 70%, optionally at least 80%, preferably at least 85%, more preferably at least 90% and most preferably at least 95% homologous to a polypeptide having the sequence GGNSSLHS-GTEPHLHLQARLVLRAEQAGGV-PAVRAAAQVPPGLRRGQTRN corresponding to amino acids 103-152 of HUMTNFRII_PEA_1_P18, wherein said first amino acid sequence and second amino acid sequence are contiguous and in a sequential order.

2. An isolated polypeptide for a tail of HUMTNFRII_PEA_1_P18, comprising a polypeptide being at least 70%, optionally at least about 80%, preferably at least about 85%, more preferably at least about 90% and most preferably at least about 95% homologous to the sequence GGNSSLHS-GTEPHLHLQARLVLRAEQAGGV-PAVRAAAQVPPGLRRGQTRN in HUMTNFRII_PEA_1_P18.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTNFRII_PEA_1_P18 also has the following non-silent SNPs (Single Nucleotide Polymorphisms) as listed in Table 279, (given according to their position(s) on the amino acid sequence, with the alternative amino acid(s) listed; the last column indicates whether the SNP is known or not; the presence of known SNPs in variant protein HUMTNFRII_PEA_1_P18 sequence provides support for the deduced sequence of this variant protein according to the present invention).

TABLE 279

Amino acid mutations

| SNP position(s) on amino acid sequence | Alternative amino acid(s) | Previously known SNP? |
|---|---|---|
| 25 | A → | No |
| 47 | D → G | No |
| 61 | Q → R | No |
| 81 | S → G | No |
| 117 | H → R | No |

The glycosylation sites of variant protein HUMTNFRII_PEA_1_P18, as compared to the known protein Tumor necrosis factor receptor superfamily member 1B precursor, are described in Table 280 (given according to their position(s) on the amino acid sequence in the first column; the second column indicates whether the glycosylation site is present in the variant protein; and the last column indicates whether the position is different on the variant protein).

TABLE 280

| Glycosylation site(s) | | |
|---|---|---|
| Position(s) on known amino acid sequence | Present in variant protein? | Position in variant protein? |
| 171 | no | |
| 193 | no | |

The variant protein has the following domains, as determined by using InterPro. The domains are described in Table 281:

TABLE 281

| InterPro domain(s) | | | |
|---|---|---|---|
| InterPro ID | Domain description | Analysis type | Position(s) on protein |
| IPR001368 | TNFR/CD27/30/40/95 cysteine-rich region | HMMPfam | 40-75, 78-103 |
| IPR001368 | TNFR/CD27/30/40/95 cysteine-rich region | HMMSmart | 40-75, 78-113 |
| IPR007087 | Zn-finger, C2H2 type | ScanRegExp | 93-115 |
| IPR001368 | TNFR/CD27/30/40/95 cysteine-rich region | ScanRegExp | 40-75 |
| IPR001368 | TNFR/CD27/30/40/95 cysteine-rich region | ProfileScan | 39-75 |

Variant protein HUMTNFRII_PEA_1_P18 is encoded by the following transcript(s): HUMTNFRII_PEA_1_T9. The coding portion of transcript HUMTNFRII_PEA_1_T9 starts at position 108 and ends at position 563. The transcript also has the following SNPs as listed in Table 282 (given according to their position on the nucleotide sequence, with the alternative nucleic acid listed; the last column indicates whether the SNP is known or not; the presence of known SNPs in variant protein HUMTNFRII_PEA_1_P18 sequence provides support for the deduced sequence of this variant protein according to the present invention).

TABLE 282

| Nucleic acid SNPs | | |
|---|---|---|
| SNP position on nucleotide sequence | Alternative nucleic acid | Previously known SNP? |
| 33 | G → T | Yes |
| 49 | C → T | Yes |
| 181 | C → | No |
| 247 | A → G | No |
| 275 | A → G | Yes |
| 289 | A → G | No |
| 290 | A → G | No |
| 348 | A → G | No |
| 449 | G → A | No |
| 457 | A → G | No |
| 560 | G → A | No |
| 599 | → C | No |
| 599 | → G | No |
| 613 | A → | No |

TABLE 282-continued

| Nucleic acid SNPs | | |
|---|---|---|
| SNP position on nucleotide sequence | Alternative nucleic acid | Previously known SNP? |
| 645 | C → T | Yes |
| 661 | G → A | Yes |
| 689 | T → | No |
| 689 | T → G | Yes |
| 796 | G → A | Yes |
| 808 | G → A | Yes |
| 810 | T → C | No |
| 831 | C → | No |
| 862 | A → T | No |
| 878 | C → T | No |
| 893 | T → C | Yes |
| 943 | T → C | No |
| 945 | T → | No |
| 945 | T → C | No |
| 986 | A → G | Yes |
| 1005 | T → C | No |
| 1016 | C → T | No |
| 1027 | C → T | No |
| 1091 | C → | No |
| 1186 | → A | No |
| 1186 | → G | No |
| 1187 | G → A | No |
| 1307 | G → A | No |
| 1418 | C → | No |
| 1444 | C → | No |
| 1445 | C → | No |
| 1445 | C → A | No |
| 1501 | G → A | No |
| 1502 | G → A | No |
| 1502 | G → C | No |
| 1676 | G → A | Yes |
| 1681 | T → G | Yes |
| 1703 | T → C | Yes |
| 1808 | C → T | No |
| 1861 | C → | No |
| 1875 | C → A | Yes |
| 1913 | C → T | Yes |
| 1941 | A → G | Yes |
| 1960 | T → C | Yes |
| 1966 | C → G | Yes |
| 2148 | C → T | Yes |
| 2326 | C → G | Yes |
| 2382 | → A | No |
| 2410 | C → T | Yes |
| 2568 | C → T | Yes |
| 2660 | C → T | No |
| 2665 | C → T | Yes |
| 2753 | C → T | Yes |
| 2906 | T → C | Yes |
| 2910 | G → A | Yes |
| 2982 | A → G | Yes |
| 3041 | C → A | Yes |
| 3048 | C → T | Yes |
| 3132 | G → A | Yes |
| 3248 | G → A | Yes |

Variant protein HUMTNFRII_PEA_1_P19 according to the present invention is encoded by transcript(s) HUMTNFRII_PEA_1_T10. An alignment is given to the known protein (Tumor necrosis factor receptor superfamily member 1B precursor) in FIG. 210. One or more alignments to one or more previously published protein sequences are given in FIGS. 206-209. A brief description of the relationship of the variant protein according to the present invention to each such aligned protein is as follows:

Comparison Report Between HUMTNFRII_PEA_1_P19 and TR1B_HUMAN:

1. An isolated chimeric polypeptide HUMTNFRII_PEA_1_P19, comprising a first amino acid sequence being at least 90% homologous to MAPVAVWAALAVGLELWAAA-HALPAQVAFTPYAPEPGSTCRLREYYDQTA QMCCSKCSPGQHAKVFCTKTSDTVCD-SCEDSTYTQLWNWVPECLSCGSRCSS DQVETQAC-TREQNRICTCRPGWYCALSKQEGCRLCA-PLRKCRPGFGVARPGT ETSDVVCKPCAPGTFSNTTSSTDICRPH-QICNVVAIPGNASMDAVCTSTSPTRS MAP-GAVHLPQPVSTRSQHTQPTPEP-STAPSTSFLLPMGPSPPAEGSTGDFALPV corresponding to amino acids 1-262 of TR1B_HUMAN, which also corresponds to amino acids 1-262 of HUMTNFRII_PEA__1_P19, and a second amino acid sequence being at least 70%, optionally at least 80%, preferably at least 85%, more preferably at least 90% and most preferably at least 95% homologous to a polypeptide having the sequence ASLACR corresponding to amino acids 263-268 of HUMTNFRII_PEA__1_P19, wherein said first amino acid sequence and second amino acid sequence are contiguous and in a sequential order.

2. An isolated polypeptide for a tail of HUMTNFRII_PEA__1_P19, comprising a polypeptide being at least 70%, optionally at least about 80%, preferably at least about 85%, more preferably at least about 90% and most preferably at least about 95% homologous to the sequence ASLACR in HUMTNFRII_PEA__1_P19.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTNFRII_PEA__1_P19 also has the following non-silent SNPs (Single Nucleotide Polymorphisms) as listed in Table 283, (given according to their position(s) on the amino acid sequence, with the alternative amino acid(s) listed; the last column indicates whether the SNP is known or not; the presence of known SNPs in variant protein HUMTNFRII_PEA__1_P19 sequence provides support for the deduced sequence of this variant protein according to the present invention).

TABLE 283

Amino acid mutations

| SNP position(s) on amino acid sequence | Alternative amino acid(s) | Previously known SNP? |
|---|---|---|
| 25 | A → | No |
| 47 | D → G | No |
| 61 | Q → R | No |
| 81 | S → G | No |
| 116 | R → H | No |
| 119 | T → A | No |
| 153 | G → E | No |
| 171 | N → | No |
| 187 | V → M | Yes |
| 196 | M → | No |
| 196 | M → R | Yes |
| 232 | E → K | Yes |
| 236 | A → T | Yes |
| 243 | L → | No |
| 254 | S → C | No |
| 259 | A → V | No |
| 264 | S → P | No |

The glycosylation sites of variant protein HUMTNFRII_PEA__1_P19, as compared to the known protein Tumor necrosis factor receptor superfamily member 1B precursor, are described in Table 284 (given according to their position(s) on the amino acid sequence in the first column; the second column indicates whether the glycosylation site is present in the variant protein; and the last column indicates whether the position is different on the variant protein).

TABLE 284

Glycosylation site(s)

| Position(s) on known amino acid sequence | Present in variant protein? | Position in variant protein? |
|---|---|---|
| 171 | yes | 171 |
| 193 | yes | 193 |

The variant protein has the following domains, as determined by using InterPro. The domains are described in Table 285:

TABLE 285

InterPro domain(s)

| InterPro ID | Domain description | Analysis type | Position(s) on protein |
|---|---|---|---|
| IPR001368 | TNFR/CD27/30/40/95 cysteine-rich region | HMMPfam | 40-75, 78-118 |
| IPR001368 | TNFR/CD27/30/40/95 cysteine-rich region | HMMSmart | 120-161, 164-200, 40-75, 78-118 |
| IPR001368 | TNFR/CD27/30/40/95 cysteine-rich region | ScanRegExp | 40-75, 78-118 |
| IPR001368 | TNPR/CD27/30/40/95 cysteine-rich region | ProfileScan | 119-161, 39-75, 77-118 |

Variant protein HUMTNFRII_PEA__1_P19 is encoded by the following transcript(s): HUMTNFRII_PEA__1_T10. The coding portion of transcript HUMTNFRII_PEA__1_T10 starts at position 108 and ends at position 911. The transcript also has the following SNPs as listed in Table 286 (given according to their position on the nucleotide sequence, with the alternative nucleic acid listed; the last column indicates whether the SNP is known or not; the presence of known SNPs in variant protein HUMTNFRII_PEA__1_P19 sequence provides support for the deduced sequence of this variant protein according to the present invention).

TABLE 286

Nucleic acid SNPs

| SNP position on nucleotide sequence | Alternative nucleic acid | Previously known SNP? |
|---|---|---|
| 33 | G → T | Yes |
| 49 | C → T | Yes |
| 181 | C → | No |
| 247 | A → G | No |
| 275 | A → G | Yes |
| 289 | A → G | No |
| 290 | A → G | No |
| 348 | A → G | No |
| 454 | G → A | No |
| 462 | A → G | No |
| 565 | G → A | No |
| 604 | → C | No |
| 604 | → G | No |
| 618 | A → | No |
| 650 | C → T | Yes |
| 666 | G → A | Yes |
| 694 | T → | No |
| 694 | T → G | Yes |
| 801 | G → A | Yes |

TABLE 286-continued

Nucleic acid SNPs

| SNP position on nucleotide sequence | Alternative nucleic acid | Previously known SNP? |
|---|---|---|
| 813 | G → A | Yes |
| 815 | T → C | No |
| 836 | C → | No |
| 867 | A → T | No |
| 883 | C → T | No |
| 897 | T → C | No |
| 908 | C → T | No |
| 919 | C → T | No |
| 983 | C → | No |
| 1078 | → A | No |
| 1078 | → G | No |
| 1079 | G → A | No |
| 1199 | G → A | No |
| 1310 | C → | No |
| 1336 | C → | No |
| 1337 | C → | No |
| 1337 | C → A | No |
| 1393 | G → A | No |
| 1394 | G → A | No |
| 1394 | G → C | No |
| 1568 | G → A | Yes |
| 1573 | T → G | Yes |
| 1595 | T → C | Yes |
| 1700 | C → T | No |
| 1753 | C → | No |
| 1767 | C → A | Yes |
| 1805 | C → T | Yes |
| 1833 | A → G | Yes |
| 1852 | T → C | Yes |
| 1858 | C → G | Yes |
| 2040 | C → T | Yes |
| 2218 | C → G | Yes |
| 2274 | → A | No |
| 2302 | C → T | Yes |
| 2460 | C → T | Yes |
| 2552 | C → T | No |
| 2557 | C → T | Yes |
| 2645 | C → T | Yes |
| 2798 | T → C | Yes |
| 2802 | G → A | Yes |
| 2874 | A → G | Yes |
| 2933 | C → A | Yes |
| 2940 | C → T | Yes |
| 3024 | G → A | Yes |
| 3140 | G → A | Yes |

The variants were found to have the following domain structure as shown in FIG. 211 in comparison to the known or wild-type (WT) protein:

Example 60

Description For Cluster HUMTNFRRP

Cluster HUMTNFRRP features 3 transcript(s) and 32 segment(s) of interest, the names for which are given in Tables 287 and 288, respectively. The selected protein variants are given in table 289.

TABLE 287

Transcripts of interest

| Transcript Name | SEQ ID NO: |
|---|---|
| HUMTNFRRP_T2 | 863 |
| HUMTNFRRP_T6 | 864 |
| HUMTNFRRP_T18 | 865 |

TABLE 288

Segments of interest

| Segment Name | SED ID NO: |
|---|---|
| HUMTNFRRP_node_3 | 866 |
| HUMTNFRRP_node_18 | 867 |
| HUMTNFRRP_node_19 | 868 |
| HUMTNFRRP_node_23 | 869 |
| HUMTNFRRP_node_25 | 870 |
| HUMTNFRRP_node_26 | 871 |
| HUMTNFRRP_node_28 | 872 |
| HUMTNFRRP_node_30 | 873 |
| HUMTNFRRP_node_31 | 874 |
| HUMTNFRRP_node_33 | 875 |
| HUMTNFRRP_node_34 | 876 |
| HUMTNFRRP_node_36 | 877 |
| HUMTNFRRP_node_37 | 878 |
| HUMTNFRRP_node_42 | 879 |
| HUMTNFRRP_node_4 | 880 |
| HUMTNFRRP_node_5 | 881 |
| HUMTNFRRP_node_6 | 882 |
| HUMTNFRRP_node_7 | 883 |
| HUMTNFRRP_node_10 | 884 |
| HUMTNFRRP_node_13 | 885 |
| HUMTNFRRP_node_14 | 886 |
| HUMTNFRRP_node_16 | 887 |
| HUMTNFRRP_node_17 | 888 |
| HUMTNFRRP_node_20 | 889 |
| HUMTNFRRP_node_22 | 890 |
| HUMTNFRRP_node_24 | 891 |
| HUMTNFRRP_node_27 | 892 |
| HUMTNFRRP_node_29 | 893 |
| HUMTNFRRP_node_38 | 894 |
| HUMTNFRRP_node_39 | 895 |
| HUMTNFRRP_node_40 | 896 |
| HUMTNFRRP_node_41 | 897 |

TABLE 289

Proteins of interest

| Protein Name | SEQ ID NO: | Protein Length | Corresponding Transcript(s) |
|---|---|---|---|
| HUMTNFRPP_P2 | 898 | P166 | HUMTNFRRP_T2 |
| HUMTNFRRP_P4 | 899 | p255 | HUMTNFRRP_T6 |
| HUMTNFRRP_P9 | 900 | P181 | HUMTNFRRP_T18 |

These sequences are variants of the known protein Tumor necrosis factor receptor superfamily member 3 precursor (SwissProt accession identifier TNR3_HUMAN; SEQ ID NO:129; known also according to the synonyms Lymphotoxin-beta receptor; Tumor necrosis factor receptor 2 related protein; Tumor necrosis factor C receptor), referred to herein as the previously known protein.

Protein Tumor necrosis factor receptor superfamily member 3 precursor is known or believed to have the following function(s): Receptor for the heterotrimeric lymphotoxin containing LTA and LTB, and for TNFS14/LIGHT. Promotes apoptosis via TRAF3 and TRAF5. May play a role in the development of lymphoid organs. The sequence for protein Tumor necrosis factor receptor superfamily member 3 precursor is given in SEQ ID NO: 129, as "Tumor necrosis factor receptor superfamily member 3 precursor amino acid sequence". Protein Tumor necrosis factor receptor superfamily member 3 precursor localization is believed to be Type I membrane protein.

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Immunosuppressant; Leucotriene modulator. A therapeutic role for a protein represented by the cluster has been predicted. The cluster was assigned this field because there was information in the drug database or the public databases (e.g., described herein above) that this protein, or part thereof, is used or can be used for a potential therapeutic indication: Immunosuppressant.

The following GO Annotation(s) apply to the previously known protein. The following annotation(s) were found: apoptosis; immune response; signal transduction, which are annotation(s) related to Biological Process; transmembrane receptor; protein binding, which are annotation(s) related to Molecular Function; and integral membrane protein, which are annotation(s) related to Cellular Component.

The GO assignment relies on information from one or more of the SwissProt/TremB1 Protein knowledgebase, or Locuslink.

Tumor necrosis factor receptor-3 (TNR3) Lymphotoxin-β receptor (LT-βR) binds specifically to two ligands: the membrane form of lymphotoxin, LT-α1/β2, and LIGHT, which are expressed only on activated lymphoid cells and activated T cells respectively. LT-βR stimulation leads to induction of inflammatory response and is involved in normal development of lymphoid organs. In addition its stimulation can induce cell death, chemokine secretion, and activation of NFκB. In vivo blockade of LIGHT and LT1β2 by administration of soluble LTβR-Ig inhibited CTL response and ameliorated lethal GVHD in a B6 to BDF1 mouse model. Treatment of rodents with the fusion protein, LT-βR-Ig prevents the development of autoimmune diseases including but not limited to insulitis and uveitis.

FIG. 212 depicts the clinical trials involve TNR3-lymphotoxin beta.

As noted above, cluster HUMTNFRRP features 3 transcript(s), which were listed in Table 287 above. These transcript(s) encode for protein(s) which are variant(s) of protein Tumor necrosis factor receptor superfamily member 3 precursor. A description of each variant protein according to the present invention is now provided.

Variant protein HUMTNFRRP_P2 according to the present is encoded by transcript(s) HUMTNFRRP_T2. An alignment is given to the known protein (Tumor necrosis factor receptor superfamily member 3 precursor; SEQ ID NO:129) in FIG. 213. One or more alignments to one or more previously published protein sequences are given in FIGS. 214-215. A brief description of the relationship of the variant protein according to the present invention to each such aligned protein is as follows:

Comparison Report Between HUMTNFRRP_P2 and TNR3_HUMAN:

1. An isolated chimeric polypeptide HUMTNFRRP_P2, comprising a first amino acid sequence being at least 90% homologous to MLLPWATSAPGLAWGPLVLGLFGL-LAASQPQAVPPYASENQTCRDQEKEYY EPQHRICCS-RCPPGTYVSAKCSRIRDTVCATCAEN-SYNEHWNYLTICQLCRPC DPVMGLEEIAPCTSKRKTQCRCQPGMF-CAAWALECTHCELLSDCPPGTEAEL K corresponding to amino acids 1-157 of TNR3_HUMAN, which also corresponds to amino acids 1-157 of HUMTNFRRP_P2, and a second amino acid sequence being at least 70%, optionally at least 80%, preferably at least 85%, more preferably at least 90% and most preferably at least 95% homologous to a polypeptide having the sequence GQRSLRGWM corresponding to amino acids 158-166 of HUMTNFRRP_P2, wherein said first amino acid sequence and second amino acid sequence are contiguous and in a sequential order.

2. An isolated polypeptide for a tail of HUMTNFRRP_P2, comprising a polypeptide being at least 70%, optionally at least about 80%, preferably at least about 85%, more preferably at least about 90% and most preferably at least about 95% homologous to the sequence GQRSLRGWM in HUMTNFRRP_P2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTNFRRP_P2 also has the following non-silent SNPs (Single Nucleotide Polymorphisms) as listed in Table 290, (given according to their position(s) on the amino acid sequence, with the alternative amino acid(s) listed; the last column indicates whether the SNP is known or not; the presence of known SNPs in variant protein HUMTNFRRP_P2 sequence provides support for the deduced sequence of this variant protein according to the present invention).

TABLE 290

Amino acid mutations

| SNP position(s) on amino acid sequence | Alternative amino acid(s) | Previously known SNP? |
|---|---|---|
| 92 | W → C | Yes |

The glycosylation sites of variant protein HUMTNFR-RP_P2, as compared to the known protein Tumor necrosis factor receptor superfamily member 3 precursor, are described in Table 291 (given according to their position(s) on the amino acid sequence in the first column; the second column indicates whether the glycosylation site is present in the variant protein; and the last column indicates whether the position is different on the variant protein).

TABLE 291

Glycosylation site(s)

| Position(s) on known amino acid sequence | Present in variant protein? | Position in variant protein? |
|---|---|---|
| 40 | yes | 40 |
| 177 | no | |

The variant protein has the following domains, as determined by using InterPro. The domains are described in Table 292:

TABLE 292

InterPro domain(s)

| InterPro ID | Domain description | Analysis type | Position(s) on protein |
|---|---|---|---|
| IPR008063 | Fas receptor | FPrintScan | 115-142, 61-75, 97-113 |
| IPR001368 | TNFR/CD27/30/40/95 cysteine-rich region | HMMPfam | 43-80, 83-124 |
| IPR001368 | TNFR/CD27/30/40/95 cysteine-rich region | HMMSmart | 126-160, 43-80, 83-124 |
| IPR001368 | TNFR/CD27/30/40/95 cysteine-rich region | ScanRegExp | 43-80, 83-126 |
| IPR001368 | TNFR/CD27/30/40/95 cysteine-rich region | ProfileScan | 42-80, 82-124 |

Variant protein HUMTNFRRP_P2 is encoded by the following transcript(s): HUMTNFRRP_T2. The coding portion of transcript HUMTNFRRP_T2 starts at position 261 and ends at position 758. The transcript also has the following SNPs as listed in Table 293 (given according to their position on the nucleotide sequence, with the alternative nucleic acid listed; the last column indicates whether the SNP is known or not; the presence of known SNPs in variant protein HUMTNFRRP_P2 sequence provides support for the deduced sequence of this variant protein according to the present invention).

TABLE 293

Nucleic acid SNPs

| SNP position on nucleotide sequence | Alternative nucleic acid | Previously known SNP? |
|---|---|---|
| 87 | G → A | Yes |
| 87 | G → T | No |
| 108 | C → | No |
| 416 | G → A | Yes |
| 486 | C → A | No |
| 536 | G → T | Yes |
| 1463 | A → C | Yes |
| 2125 | G → A | Yes |
| 3262 | C → T | Yes |
| 3263 | A → G | Yes |
| 3520 | T → A | Yes |
| 3743 | C → T | No |
| 3752 | C → T | No |
| 4666 | A → G | Yes |
| 4699 | C → G | Yes |
| 4738 | A → G | Yes |
| 4780 | C → T | Yes |
| 5237 | T → C | No |
| 5366 | C → T | Yes |
| 5466 | G → | No |
| 5475 | A → G | Yes |
| 5672 | G → A | Yes |
| 5790 | G → T | Yes |
| 5887 | C → G | Yes |
| 5973 | T → C | Yes |
| 6134 | G → T | Yes |
| 6413 | A → C | Yes |

Variant protein HUMTNFRRP_P4 according to the present invention is encoded by transcript(s) HUMTNFRRP_T6. An alignment is given to the known protein (Tumor necrosis factor receptor superfamily member 3 precursor) in FIG. 214. One or more alignments to one or more previously published protein sequences are given in Figures XX. A brief description of the relationship of the variant protein according to the present invention to each such aligned protein is as follows:

Comparison Report Between HUMTNFRRP_P4 and TNR3_HUMAN:

1. An isolated chimeric polypeptide HUMTNFRRP_P4, comprising a first amino acid sequence being at least 90% homologous to MLLPWATSAPGLAWGPLVLGLFGL-LAASQPQAVPPYASENQTCRDQEKEYY EPQHRICCS-RCPPGTYVSAKCSRIRDTVCATCAEN-SYNEHWNYLTICQLCRPC DPVMGLEEIAPCTSKRKTQCRCQPGMF-CAAWALECTHCELLSDCPPGTEAEL KDEVGKGNNH-CVPCKAGHFQNTSSPSARCQPHTRCEN-QGLVEAAPGTAQSD TTCKNPLEPLPPEMS corresponding to amino acids 1-222 of TNR3_HUMAN, which also corresponds to amino acids 1-222 of HUMTNFR-RP_P4, and a second amino acid sequence being at least 70%, optionally at least 80%, preferably at least 85%, more preferably at least 90% and most preferably at least 95% homologous to a polypeptide having the sequence EPALSKGVEN-LQALLYQAATGSSEASFPTLSPL corresponding to amino acids 223-255 of HUMTNFRRP_P4, wherein said first amino acid sequence and second amino acid sequence are contiguous and in a sequential order.

2. An isolated polypeptide for a tail of HUMTNFRRP_P4, comprising a polypeptide being at least 70%, optionally at least about 80%, preferably at least about 85%, more preferably at least about 90% and most preferably at least about 95% homologous to the sequence EPALSKGVENLQAL-LYQAATGSSEASFPTLSPL in HUMTNFRRP_P4.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTNFRRP_P4 also has the following non-silent SNPs (Single Nucleotide Polymorphisms) as listed in Table 294, (given according to their position(s) on the amino acid sequence, with the alternative amino acid(s) listed; the last column indicates whether the SNP is known or not; the presence of known SNPs in variant protein HUMTNFRRP_P4 sequence provides support for the deduced sequence of this variant protein according to the present invention).

TABLE 294

| SNP position(s) on amino acid sequence | Alternative amino acid(s) | Previously known SNP? |
|---|---|---|
| 92 | W → C | Yes |

The glycosylation sites of variant protein HUMTNFRRP_P4, as compared to the known protein Tumor necrosis factor receptor superfamily member 3 precursor, are described in Table 295 (given according to their position(s) on the amino acid sequence in the first column; the second column indicates whether the glycosylation site is present in the variant protein; and the last column indicates whether the position is different on the variant protein).

TABLE 295

| Position(s) on known amino acid sequence | Present in variant protein? | Position in variant protein? |
|---|---|---|
| 40 | yes | 40 |
| 177 | yes | 177 |

The variant protein has the following domains, as determined by using InterPro. The domains are described in Table 296:

TABLE 296

| InterPro ID | Domain description | Analysis type | Position(s) on protein |
|---|---|---|---|
| IPR008063 | Fas receptor | FPrintScan | 115-142, 61-75, 97-113 |
| IPR001368 | TNFR/CD27/30/40/95 cysteine-rich region | HMMPfam | 43-80, 83-124 |
| IPR001368 | TNFR/CD27/30/40/95 cysteine-rich region | HMMSmart | 126-167, 170-210, 43-80, 83-124 |
| IPR001368 | TNFR/CD27/30/40/95 cysteine-rich region | ScanRegExp | 43-80, 83-126 |
| IPR001368 | TNFR/CD27/30/40/95 cysteine-rich region | ProfileScan | 169-210, 42-80, 82-124 |

Variant protein HUMTNFRRP_P4 is encoded by the following transcript(s): HUMTNFRRP_T6. The coding portion of transcript HUMTNFRRP_T6 starts at position 261 and ends at position 1025. The transcript also has the following SNPs as listed in Table 297 (given according to their position on the nucleotide sequence, with the alternative nucleic acid listed; the last column indicates whether the SNP is known or not; the presence of known SNPs in variant protein HUMTNFRRP_P4 sequence provides support for the deduced sequence of this variant protein according to the present invention).

TABLE 297

| SNP position on nucleotide sequence | Alternative nucleic acid | Previously known SNP? |
|---|---|---|
| 87 | G → A | Yes |
| 87 | G → T | No |
| 108 | C → | No |
| 416 | G → A | Yes |
| 486 | C → A | No |
| 536 | G → T | Yes |
| 776 | A → C | Yes |
| 1136 | T → A | Yes |
| 1359 | C → T | No |
| 1368 | C → T | No |
| 2282 | A → G | Yes |
| 2315 | C → G | Yes |
| 2354 | A → G | Yes |
| 2396 | C → T | Yes |
| 2853 | T → C | No |
| 2982 | C → T | Yes |
| 3082 | G → | No |
| 3091 | A → G | Yes |
| 3288 | G → A | Yes |
| 3406 | G → T | Yes |
| 3503 | C → G | Yes |
| 3589 | T → C | Yes |
| 3750 | G → T | Yes |
| 4029 | A → C | Yes |

Variant protein HUMTNFRRP_P9 according to the present invention is encoded by transcript(s) HUMTNFRRP_T18. An alignment is given to the known protein (Tumor necrosis factor receptor superfamily member 3 precursor) in FIG. 215. One or more alignments to one or more previously published protein sequences are given in FIGS. 213-214. A brief description of the relationship of the variant protein according to the present invention to each such aligned protein is as follows:

Comparison Report Between HUMTNFRRP_P9 and TNR3_HUMAN:

1. An isolated chimeric polypeptide HUMTNFRRP_P9, comprising a first amino acid sequence being at least 90% homologous to MLLPWATSAPGLAWGPLVLGLFGL-LAASQPQAVPPYASENQTCRDQEKEYY EPQHRICCS-RCPPGTYVSAKCSRIRDTVCATCAEN-SYNEHWNYLTICQLCRPC DPVMGLEEIAPCTSKRKTQCRCQPGMF-CAAWALECTHCELLSDCPPGTEAEL K corresponding to amino acids 1-157 of TNR3_HUMAN, which also corresponds to amino acids 1-157 of HUMTNFRRP_P9, and a second amino acid sequence being at least 70%, optionally at least 80%, preferably at least 85%, more preferably at least 90% and most preferably at least 95% homologous to a polypeptide having the sequence GVRTKVW-WRQLQALPSPTQPAKIH corresponding to amino acids 158-181 of HUMTNFRRP_P9, wherein said first amino acid sequence and second amino acid sequence are contiguous and in a sequential order.

2. An isolated polypeptide for a tail of HUMTNFRRP_P9, comprising a polypeptide being at least 70%, optionally at least about 80%, preferably at least about 85%, more preferably at least about 90% and most preferably at least about 95% homologous to the sequence GVRTKVW-WRQLQALPSPTQPAKIH in HUMTNFRRP_P9.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTNFRRP_P9 also has the following non-silent SNPs (Single Nucleotide Polymorphisms) as listed in Table 298, (given according to their position(s) on the amino acid sequence, with the alternative amino acid(s) listed; the last column indicates whether the SNP is known or not; the presence of known SNPs in variant protein HUMTNFRRP_P9 sequence provides support for the deduced sequence of this variant protein according to the present invention).

TABLE 298

Amino acid mutations

| SNP position(s) on amino acid sequence | Alternative amino acid(s) | Previously known SNP? |
|---|---|---|
| 92 | W → C | Yes |

The glycosylation sites of variant protein HUMTNFRRP_P9, as compared to the known protein Tumor necrosis factor receptor superfamily member 3 precursor, are described in Table 299 (given according to their position(s) on the amino acid sequence in the first column; the second column indicates whether the glycosylation site is present in the variant protein; and the last column indicates whether the position is different on the variant protein).

TABLE 299

Glycosylation site(s)

| Position(s) on known amino acid sequence | Present in variant protein? | Position in variant protein? |
|---|---|---|
| 40 | yes | 40 |
| 177 | no | |

The variant protein has the following domains, as determined by using InterPro. The domains are described in Table 300:

TABLE 300

InterPro domain(s)

| InterPro ID | Domain description | Analysis type | Position(s) on protein |
|---|---|---|---|
| IPR008063 | Fas receptor | FPrintScan | 115-142, 61-75, 97-113 |
| IPR001368 | TNFR/CD27/30/40/95 cysteine-rich region | HMMPfam | 43-80, 83-124 |

TABLE 300-continued

InterPro domain(s)

| InterPro ID | Domain description | Analysis type | Position(s) on protein |
|---|---|---|---|
| IPR001368 | TNFR/CD27/30/40/95 cysteine-rich region | HMMSmart | 126-160, 43-80, 83-124 |
| IPR001368 | TNFR/CD27/30/40/95 cysteine-rich region | ScanRegExp | 43-80, 83-126 |
| IPR001368 | TNFR/CD27/30/40/95 cysteine-rich region | ProfileScan | 42-80, 82-124 |

Variant protein HUMTNFRRP_P9 is encoded by the following transcript(s): HUMTNFRRP_T18. The coding portion of transcript HUMTNFRRP_T18 starts at position 261 and ends at position 803. The transcript also has the following SNPs as listed in Table 301 (given according to their position on the nucleotide sequence, with the alternative nucleic acid listed; the last column indicates whether the SNP is known or not; the presence of known SNPs in variant protein HUMTNFRRP_P9 sequence provides support for the deduced sequence of this variant protein according to the present invention).

TABLE 301

Nucleic acid SNPs

| SNP position on nucleotide sequence | Alternative nucleic acid | Previously known SNP? |
|---|---|---|
| 87 | G → A | Yes |
| 87 | G → T | No |
| 108 | C → | No |
| 416 | G → A | Yes |
| 486 | C → A | No |
| 536 | G → T | Yes |
| 1007 | C → T | No |
| 1016 | C → T | No |
| 1930 | A → G | Yes |
| 1963 | C → G | Yes |
| 2002 | A → G | Yes |
| 2044 | C → T | Yes |
| 2501 | T → C | No |
| 2630 | C → T | Yes |
| 2730 | G → | No |
| 2739 | A → G | Yes |
| 2936 | G → A | Yes |
| 3054 | G → T | Yes |
| 3151 | C → G | Yes |
| 3237 | T → C | Yes |
| 3398 | G → T | Yes |
| 3677 | A → C | Yes |

FIG. 216 depicts the domain structure of the TNFRRP variants in comparison to the known or wild-type (WT) protein.

Example 61

Description for Cluster HUMCLMF35

Cluster HUMCLMF35 features 6 transcript(s) and 20 segment(s) of interest, the names for which are given in Tables 302 and 303, respectively. The selected protein variants are given in table 304.

TABLE 302

Transcripts of interest

| Transcript Name | SEQ ID NO: |
|---|---|
| HUMCLMF35_PEA_1_PEA_2_T1 | 901 |
| HUMCLMF35_PEA_1_PEA_2_T5 | 902 |
| HUMCLMF35_PEA_1_PEA_2_T6 | 903 |
| HUMCLMF35_PEA_1_PEA_2_T7 | 904 |
| HUMCLMF35_PEA_1_PEA_2_T10 | 905 |
| HUMCLMF35_PEA_1_PEA_2_T12 | 906 |

TABLE 303

Segments of interest

| Segment Name | SEQ ID NO: |
|---|---|
| HUMCLMF35_PEA_1_PEA_2_node_0 | 907 |
| HUMCLMF35_PEA_1_PEA_2_node_15 | 908 |
| HUMCLMF35_PEA_1_PEA_2_node_20 | 909 |
| HUMCLMF35_PEA_1_PEA_2_node_22 | 910 |
| HUMCLMF35_PEA_1_PEA_2_node_1 | 911 |
| HUMCLMF35_PEA_1_PEA_2_node_2 | 912 |
| HUMCLMF35_PEA_1_PEA_2_node_3 | 913 |
| HUMCLMF35_PEA_1_PEA_2_node_4 | 914 |
| HUMCLMF35_PEA_1_PEA_2_node_5 | 915 |
| HUMCLMF35_PEA_1_PEA_2_node_6 | 916 |
| HUMCLMF35_PEA_1_PEA_2_node_8 | 917 |
| HUMCLMF35_PEA_1_PEA_2_node_9 | 918 |
| HUMCLMF35_PEA_1_PEA_2_node_10 | 919 |
| HUMCLMF35_PEA_1_PEA_2_node_11 | 920 |
| HUMCLMF35_PEA_1_PEA_2_node_13 | 921 |
| HUMCLMF35_PEA_1_PEA_2_node_14 | 922 |
| HUMCLMF35_PEA_1_PEA_2_node_16 | 923 |
| HUMCLMF35_PEA_1_PEA_2_node_17 | 924 |
| HUMCLMF35_PEA_1_PEA_2_node_18 | 925 |
| HUMCLMF35_PEA_1_PEA_2_node_19 | 926 |

TABLE 304

Proteins of interest

| Protein Name | SEQ ID NO: | Protein Length | Corresponding Transcript(s) |
|---|---|---|---|
| HUMCLMF35_PEA_1_PEA_2_P14 | 927 | P130 | HUMCLMF35_PEA_1_PEA_2_T1 |
| HUMCLMF35_PEA_1_PEA_2_P15 | 928 | P93 | HUMCLMF35_PEA_1_PEA_2_T5 |
| HUMCLMF35_PEA_1_PEA_2_P16 | 929 | P205 | HUMCLMF35_PEA_1_PEA_2_T6 |
| HUMCLMF35_PEA_1_PEA_2_P17 | 930 | P181 | HUMCLMF35_PEA_1_PEA_2_T7 |
| HUMCLMF35_PEA_1_PEA_2_P20 | 931 | P153 | HUMCLMF35_PEA_1_PEA_2_T10 |
| HUMCLMF35_PEA_1_PEA_2_P22 | 932 | P171 | HUMCLMF35_PEA_1_PEA_2_T12 |

These sequences are variants of the known protein Interleukin-12 alpha chain precursor (SwissProt accession identifier I12A_HUMAN; known also according to the synonyms IL-12A; Cytotoxic lymphocyte maturation factor 35 kDa subunit; CLMF p35; NK cell stimulatory factor chain 1; NKSF1), SEQ ID NO:933, referred to herein as the previously known protein.

Protein Interleukin-12 alpha chain precursor is known or believed to have the following function(s): Cytokine that can act as a growth factor for activated T and NK cells, enhance the lytic activity of NK/lymphokine-activated Killer cells, and stimulate the production of IFN-gamma by resting PBMC. The sequence for protein Interleukin-12 alpha chain precursor is given in SEQ ID NO: 933, as "Interleukin-12 alpha chain precursor amino acid sequence". Known polymorphisms for this sequence are as shown in Table 305.

TABLE 305

Amino acid mutations for Known Protein

| SNP position(s) on amino acid sequence | Comment |
|---|---|
| 213 | M → T |

Protein Interleukin-12 alpha chain precursor localization is believed to be Secreted.

The previously known protein also has the following indication(s) and/or potential therapeutic use(s): Cancer; Infection, HIV/AIDS; Infection, hepatitis-C virus; Cancer, sarcoma, Kaposi's; Cancer, renal; Cancer, melanoma; Cancer, general; Cancer, head and neck, Cancer, ovarian. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein or of drugs directed against this protein are as follows. Immunostimulant; Interleukin 12 agonist; Interleukin 2 agonist; Natural killer cell stimulant; T cell stimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Cytokine; Anticancer; Antipsoriasis; Immunomodulator, anti-infective; Immunosuppressant; Ophthalmological.

The following GO Annotation(s) apply to the previously known protein. The following annotation(s) were found:

immune response; antimicrobial humoral response (sensu Vertebrata), which are annotation(s) related to Biological Process; defense/immunity protein; signal transducer; cytokine; interleukin-12 receptor ligand, which are annotation(s) related to Molecular Function; and extracellular; extracellular space, which are annotation(s) related to Cellular Component.

The GO assignment relies on information from one or more of the SwissProt/TremB1 Protein knowledgebase, or Locuslink.

IL-12 (p70) is a heterodimeric pro-inflammatory cytokine, composed of disulfide-linked p40 and p35 subunits. It is secreted by DCs and phagocytes in response to pathogens during infection. It induces the production IFNg (from T cells and NKs), favors the differentiation of Th1cells. IL-12R is a heterodimer composed of IL-12Rb1 and IL-12Rb2. Individually, each subunit binds IL-12 (p70) with low affinity while interaction with the heterodimer allows high affinity IL-12 binding.

p40 homodimer acts as IL-12 antagonist. Signaling will not occur upon p40 binding to IL-12Rb1.

p35 (IL-12A) may be described as follows. Structurally, mature p35 forms a four-helix bundle. Important residues for dimerization: R211-p35-p40 interaction, C96-disulfide bond with p40. Free p35 is not secreted (without wishing to be limited to a single hypothesis, it is probably unstable in the absence of p40). Glycosylation of p35 is a regulatory step in heterodimer assembly and secretion.

Figure depicts IL12 clinical developments.

As noted above, cluster HUMCLMF35 features 6 transcript(s), which were listed in Table 302 above. These transcript(s) encode for protein(s) which are variant(s) of protein Interleukin-12 alpha chain precursor. A description of each variant protein according to the present invention is now provided.

Variant protein HUMCLMF35_PEA_1_PEA_2_P14 according to the present invention is encoded by transcript(s) HUMCLMF35_PEA_1_PEA_2_T1. An alignment is given to the known protein (Interleukin-12 alpha chain precursor; SEQ ID NO:933) in FIG. 218. One or more alignments to one or more previously published protein sequences are given in FIGS. 219-223. A brief description of the relationship of the variant protein according to the present invention to each such aligned protein is as follows:

Comparison Report Between HUMCLMF35_PEA_PEA_2_P14 and I12A_HUMAN (SEQ ID NO:933):

1. An isolated chimeric polypeptide HUMCLMF35_PEA_1_PEA_2_P14, comprising a first amino acid sequence being at least 90% homologous to MCPARSLLLVATLVLLDHLSLARNLP-VATPDPGMFPCLHHSQNLLRAVSNML QKARQTLE-FYPCTSEEIDHEDITKDKTSTVEA-CLPLELTKNESCLNSRETSFIT corresponding to amino acids 1-106 of I12A_HUMAN, which also corresponds to amino acids 1-106 of HUMCLMF35_PEA_1_PEA_2_P14, and a second amino acid sequence being at least 70%, optionally at least 80%, preferably at least 85%, more preferably at least 90% and most preferably at least 95% homologous to a polypeptide having the sequence VSQKMKSFS-LYDEFISLMSDYFFL corresponding to amino acids 107-130 of HUMCLMF35_PEA_1_PEA_2_P14, wherein said first amino acid sequence and second amino acid sequence are contiguous and in a sequential order.

2. An isolated polypeptide for a tail of HUMCLMF35_PEA_1_PEA_2_P14, comprising a polypeptide being at least 70%, optionally at least about 80%, preferably at least about 85%, more preferably at least about 90% and most preferably at least about 95% homologous to the sequence VSQKMKSFSLYDEFISLMSDYFFL in HUMCLMF35_PEA_1_PEA_2_P14.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCLMF35_PEA_1_PEA_2_P14 also has the following non-silent SNPs (Single Nucleotide Polymorphisms) as listed in Table 306, (given according to their position(s) on the amino acid sequence, with the alternative amino acid(s) listed; the last column indicates whether the SNP is known or not; the presence of known SNPs in variant protein HUMCLMF35_PEA_1_PEA_2_P14 sequence provides support for the deduced sequence of this variant protein according to the present invention).

TABLE 306

| Amino acid mutations | | |
| --- | --- | --- |
| SNP position(s) on amino acid sequence | Alternative amino acid(s) | Previously known SNP? |
| 82 | V → A | No |
| 123 | L → V | Yes |

The glycosylation sites of variant protein HUMCLMF35_PEA_1_PEA_2_P14, as compared to the known protein Interleukin-12 alpha chain precursor, are described in Table 307 (given according to their position(s) on the amino acid sequence in the first column; the second column indicates whether the glycosylation site is present in the variant protein; and the last column indicates whether the position is different on the variant protein).

TABLE 307

| Glycosylation site(s) | | |
| --- | --- | --- |
| Position(s) on known amino acid sequence | Present in variant protein? | Position in variant protein? |
| 107 | no | |
| 93 | yes | 93 |

The variant protein has the following domains, as determined by using InterPro. The domains are described in Table 308:

TABLE 308

| InterPro domain(s) | | | |
| --- | --- | --- | --- |
| InterPro ID | Domain description | Analysis type | Position(s) on protein |
| IPR004281 | Interleukin-12 alpha subunit | HMMPfam | 1-127 |

Variant protein HUMCLMF35_PEA_1_PEA_2_P14 is encoded by the following transcript(s): HUMCLMF35_PEA_1_PEA_2_T1. The coding portion of transcript HUMCLMF35_PEA_1_PEA_2_T1 starts at position 414 and ends at position 803. The transcript also has the following SNPs as listed in Table 309 (given according to their position on the nucleotide sequence, with the alternative nucleic acid listed; the last column indicates whether the SNP is known or not; the presence of known SNPs in variant protein HUMCLMF35_PEA_1_PEA_2_P14 sequence provides support for the deduced sequence of this variant protein according to the present invention).

TABLE 309

Nucleic acid SNPs

| SNP position on nucleotide sequence | Alternative nucleic acid | Previously known SNP? |
|---|---|---|
| 207 | T → C | No |
| 208 | T → A | No |
| 658 | T → C | No |
| 752 | T → C | No |
| 780 | C → G | Yes |
| 953 | A → G | Yes |
| 1118 | T → C | Yes |
| 1126 | T → C | Yes |
| 1165 | A → | No |
| 1239 | G → A | Yes |
| 1255 | T → C | Yes |
| 1262 | T → A | No |
| 1269 | G → A | Yes |

Variant protein HUMCLMF35_PEA_1_PEA_2_P15 according to the present invention is encoded by transcript(s) HUMCLMF35_PEA_1_PEA_2_T5. An alignment is given to the known protein (Interleukin-12 alpha chain precursor) in FIG. 219. One or more alignments to one or more previously published protein sequences are given in FIGS. 218, 220-223. A brief description of the relationship of the variant protein according to the present invention to each such aligned protein is as follows:

Comparison Report Between HUMCLMF35_PEA_1_PEA_2_P15 and I12A_HUMAN:

1. An isolated chimeric polypeptide HUMCLMF35_PEA_1_PEA_2_P15, comprising a first amino acid sequence being at least 90% homologous to MCPARSLLLVATLVLLDHLSLARNLP-VATPDPGMFPCLHHSQNLLRAVSNML QKARQTLE-FYPCTSEEIDHEDITKDKTSTVEACLPLELTK corresponding to amino acids 1-92 of I12A_HUMAN, which also corresponds to amino acids 1-92 of HUMCLMF35_PEA_1_PEA_2_P15, and a second amino acid sequence being at least 70%, optionally at least 80%, preferably at least 85%, more preferably at least 90% and most preferably at least 95% homologous to a polypeptide having the sequence V corresponding to amino acids 93-93 of HUMCLMF35_PEA_1_PEA_2_P15, wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCLMF35_PEA_1_PEA_2_P15 also has the following non-silent SNPs (Single Nucleotide Polymorphisms) as listed in Table 310, (given according to their position(s) on the amino acid sequence, with the alternative amino acid(s) listed; the last column indicates whether the SNP is known or not; the presence of known SNPs in variant protein HUMCLMF35_PEA_1_PEA_2_P15 sequence provides support for the deduced sequence of this variant protein according to the present invention).

TABLE 310

Amino acid mutations

| SNP position(s) on amino acid sequence | Alternative amino acid(s) | Previously known SNP? |
|---|---|---|
| 82 | V → A | No |

The glycosylation sites of variant protein HUMCLMF35_PEA_1_PEA_2_P15, as compared to the known protein Interleukin-12 alpha chain precursor, are described in Table 311 (given according to their position(s) on the amino acid sequence in the first column; the second column indicates whether the glycosylation site is present in the variant protein; and the last column indicates whether the position is different on the variant protein).

TABLE 311

Glycosylation site(s)

| Position(s) on known amino acid sequence | Present in variant protein? | Position in variant protein? |
|---|---|---|
| 107 | no | |
| 93 | no | |

The variant protein has the following domains, as determined by using InterPro. The domains are described in Table 312:

TABLE 312

InterPro domain(s)

| InterPro ID | Domain description | Analysis type | Position(s) on protein |
|---|---|---|---|
| IPR004281 | Interleukin-12 alpha subunit | HMMPfam | 1-93 |

Variant protein HUMCLMF35_PEA_1_PEA_2_P15 is encoded by the following transcript(s): HUMCLMF35_PEA_1_PEA_2_T5. The coding portion of transcript HUMCLMF35_PEA_1_PEA_2_T5 starts at position 414 and ends at position 692. The transcript also has the following SNPs as listed in Table 313 (given according to their position on the nucleotide sequence, with the alternative nucleic acid listed; the last column indicates whether the SNP is known or not; the presence of known SNPs in variant protein HUMCLMF35_PEA_1_PEA_2_P15 sequence provides support for the deduced sequence of this variant protein according to the present invention).

TABLE 313

Nucleic acid SNPs

| SNP position on nucleotide sequence | Alternative nucleic acid | Previously known SNP? |
|---|---|---|
| 207 | T → C | No |
| 208 | T → A | No |
| 658 | T → C | No |
| 760 | A → G | Yes |
| 769 | G → A | Yes |
| 857 | T → A | Yes |
| 1077 | T → C | No |
| 1105 | C → G | Yes |
| 1369 | A → G | Yes |
| 1534 | T → C | Yes |
| 1542 | T → C | Yes |
| 1581 | A → | No |
| 1655 | G → A | Yes |
| 1671 | T → C | Yes |
| 1678 | T → A | No |
| 1685 | G → A | Yes |

Variant protein HUMCLMF35_PEA_1_PEA_2_P16 according to the present invention is encoded by transcript(s) HUMCLMF35_PEA_1_PEA_2_T6. An alignment is given to the known protein (Interleukin-12 alpha chain precursor) in FIG. 220. One or more alignments to one or more previously published protein sequences are given in FIGS. 218-219 and 221-223. A brief description of the relationship of the variant protein according to the present invention to each such aligned protein is as follows:

Comparison Report Between HUMCLMF35_PEA_1_PEA_2_P16 and I12A_HUMAN:

1. An isolated chimeric polypeptide HUMCLMF35_PEA_1_PEA_2_P16, comprising a first amino acid sequence being at least 90% homologous to MCPARSLLLVATLVLLDHLSLARNLP-VATPDPGMFPCLHHSQNLLRAVSNML QKARQTLE-FYPCTSEEIDHEDITKDKTSTVEACLPLELTK corresponding to amino acids 1-92 of I12A_HUMAN, which also corresponds to amino acids 1-92 of HUMCLMF35_PEA_1_PEA_2_P16, and a second amino acid sequence being at least 90% homologous to NGSCLASRKTSFMMAL-CLSSIYEDLKMYQVEFKTMNAKLLMDPKRQIFLDQ NMLAVIDELMQALN-FNSETVPQKSSLEEPDFYKTKIKLCIL-LHAFRIRAVTIDR VMSYLNAS corresponding to amino acids 107-219 of I12A_HUMAN, which also corresponds to amino acids 93-205 of HUMCLMF35_PEA_1_PEA_2_P16, wherein said first amino acid sequence and second amino acid sequence are contiguous and in a sequential order.

2. An isolated chimeric edge portion of HUMCLMF35_PEA_1_PEA_2_P16, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KN, having a structure as follows: a sequence starting from any of amino acid numbers 92-x to 92; and ending at any of amino acid numbers 93+((n-2)-x), in which x varies from 0 to n-2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCLMF35_PEA_1_PEA_2_P16 also has the following non-silent SNPs (Single Nucleotide Polymorphisms) as listed in Table 314, (given according to their position(s) on the amino acid sequence, with the alternative amino acid(s) listed; the last column indicates whether the SNP is known or not; the presence of known SNPs in variant protein HUMCLMF35_PEA_1_PEA_2_P16 sequence provides support for the deduced sequence of this variant protein according to the present invention).

TABLE 314

Amino acid mutations

| SNP position(s) on amino acid sequence | Alternative amino acid(s) | Previously known SNP? |
|---|---|---|
| 82 | V → A | No |
| 199 | M → T | Yes |

The glycosylation sites of variant protein HUMCLMF35_PEA_1_PEA_2_P16, as compared to the known protein Interleukin-12 alpha chain precursor, are described in Table 315 (given according to their position(s) on the amino acid sequence in the first column; the second column indicates whether the glycosylation site is present in the variant protein; and the last column indicates whether the position is different on the variant protein).

TABLE 315

Glycosylation site(s)

| Position(s) on known amino acid sequence | Present in variant protein? | Position in variant protein? |
|---|---|---|
| 107 | yes | 93 |
| 93 | no | |

The variant protein has the following domains, as determined by using InterPro. The domains are described in Table 316:

TABLE 316

InterPro domain(s)

| InterPro ID | Domain description | Analysis type | Position(s) on protein |
|---|---|---|---|
| IPR004281 | Interleukin-12 alpha subunit | HMMPfam | 1-205 |

Variant protein HUMCLMF35_PEA_1_PEA_2_P16 is encoded by the following transcript(s): HUMCLMF35_PEA_1_PEA_2_T6. The coding portion of transcript HUMCLMF35_PEA_1_PEA_2_T6 starts at position 414 and ends at position 1028. The transcript also has the following SNPs as listed in Table 317 (given according to their position on the nucleotide sequence, with the alternative nucleic acid listed; the last column indicates whether the SNP is known or not; the presence of known SNPs in variant protein HUMCLMF35_PEA_1_PEA_2_P16 sequence provides support for the deduced sequence of this variant protein according to the present invention).

TABLE 317

Nucleic acid SNPs

| SNP position on nucleotide sequence | Alternative nucleic acid | Previously known SNP? |
|---|---|---|
| 207 | T → C | No |
| 208 | T → A | No |
| 658 | T → C | No |
| 836 | A → G | Yes |
| 1001 | T → C | Yes |
| 1009 | T → C | Yes |
| 1048 | A → | No |
| 1122 | G → A | Yes |
| 1138 | T → C | Yes |
| 1145 | T → A | No |
| 1152 | G → A | Yes |

Variant protein HUMCLMF35_PEA_1_PEA_2_P17 according to the present invention is encoded by transcript(s) HUMCLMF35_PEA_1_PEA_2_T7. An alignment is given to the known protein (Interleukin-12 alpha chain precursor) in FIG. 221. One or more alignments to one or more previously published protein sequences are given in FIGS. 218-220 and 222-223. A brief description of the relationship of the variant protein according to the present invention to each such aligned protein is as follows:

Comparison Report Between HUMCLMF35_PEA_1_PEA_2_P17 and I12A_HUMAN:

1. An isolated chimeric polypeptide HUMCLMF35_PEA_1_PEA_2_P17, comprising a first amino acid sequence being at least 90% homologous to MCPARSLLLVATLVLLDHLSLARNLP-VATPDPGMFPCLHHSQNLLRAVSNML Q corresponding to amino acids 1-53 of I12A_HUMAN, which also corresponds to amino acids 1-53 of HUMCLMF35_PEA_1_PEA_2_P17, and a second amino acid sequence being at least 90% homologous to KNESCLNSRETSFITNGSCLAS-RKTSFMMALCLSSIYEDLKMYQVEFKTMNAK LLM-DPKRQIFLDQNMLAVIDELMQALN-FNSETVPQKSSLEEPDFYKTKIKLCI LLHAFRIRAVTIDRVMSYLNAS corresponding to amino acids 92-219 of I12A_HUMAN, which also corresponds to amino acids 54-181 of HUMCLMF35_PEA_1_PEA_2_P17, wherein said first amino acid sequence and second amino acid sequence are contiguous and in a sequential order.

2. An isolated chimeric edge portion of HUMCLMF35_PEA_1_PEA_2_P17, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QK, having a structure as follows: a sequence starting from any of amino acid numbers 53-x to 53; and ending at any of amino acid numbers 54+((n-2)-x), in which x varies from 0 to n-2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCLMF35_PEA_1_PEA_2_P17 also has the following non-silent SNPs (Single Nucleotide Polymorphisms) as listed in Table 318, (given according to their position(s) on the amino acid sequence, with the alternative amino acid(s) listed; the last column indicates whether the SNP is known or not; the presence of known SNPs in variant protein HUMCLMF35_PEA_1_PEA_2_P17 sequence provides support for the deduced sequence of this variant protein according to the present invention).

TABLE 318

Amino acid mutations

| SNP position(s) on amino acid sequence | Alternative amino acid(s) | Previously known SNP? |
|---|---|---|
| 175 | M → T | Yes |

The glycosylation sites of variant protein HUMCLMF35_PEA_1_PEA_2_P17, as compared to the known protein Interleukin-12 alpha chain precursor, are described in Table 319 (given according to their position(s) on the amino acid sequence in the first column; the second column indicates whether the glycosylation site is present in the variant protein; and the last column indicates whether the position is different on the variant protein).

TABLE 319

Glycosylation site(s)

| Position(s) on known amino acid sequence | Present in variant protein? | Position in variant protein? |
|---|---|---|
| 107 | yes | 69 |
| 93 | yes | 55 |

The variant protein has the following domains, as determined by using InterPro. The domains are described in Table 320:

TABLE 320

InterPro domain(s)

| InterPro ID | Domain description | Analysis type | Position(s) on protein |
|---|---|---|---|
| IPR004281 | Interleukin-12 alpha subunit | HMMPfam | 1-181 |

Variant protein HUMCLMF35_PEA_1_PEA_2_P17 is encoded by the following transcript(s): HUMCLMF35_PEA_1_PEA_2_T7. The coding portion of transcript HUMCLMF35_PEA_1_PEA_2_T7 starts at position 414 and ends at position 956. The transcript also has the following SNPs as listed in Table 321 (given according to their position on the nucleotide sequence, with the alternative nucleic acid listed; the last column indicates whether the SNP is known or not; the presence of known SNPs in variant protein HUMCLMF35_PEA_1_PEA_2_P17 sequence provides support for the deduced sequence of this variant protein according to the present invention).

TABLE 321

Nucleic acid SNPs

| SNP position on nucleotide sequence | Alternative nucleic acid | Previously known SNP? |
|---|---|---|
| 207 | T → C | No |
| 208 | T → A | No |
| 764 | A → G | Yes |
| 929 | T → C | Yes |
| 937 | T → C | Yes |
| 976 | A → | No |
| 1050 | G → A | Yes |
| 1066 | T → C | Yes |
| 1073 | T → A | No |
| 1080 | G → A | Yes |

Variant protein HUMCLMF35_PEA_1_PEA_2_P20 according to the present invention is encoded by transcript(s) HUMCLMF35_PEA_1_PEA_2_T10. An alignment is given to the known protein (Interleukin-12 alpha chain precursor) in FIG. 222. One or more alignments to one or more previously published protein sequences are given in FIGS. 218-221 and 223. A brief description of the relationship of the variant protein according to the present invention to each such aligned protein is as follows:

Comparison Report Between HUMCLMF35_PEA_1_PEA_2_P20 and I12A_HUMAN:

1. An isolated chimeric polypeptide HUMCLMF35_PEA_1_PEA_2_P20, comprising a first amino acid sequence being at least 90% homologous to MCPARSLLLVATLVLLDHLSLARNLP-VATPDPGMFPCLHHSQNLLRAVSNML QK corresponding to amino acids 1-54 of I12A_HUMAN, which also corresponds to amino acids 1-54 of HUMCLMF35_PEA_1_PEA_2_P20, and a second amino acid sequence being at least 90% homologous to ALCLSSIYEDLKMYQVEFKT-MNAKLLMDPKRQIFLDQNMLAVIDELMQALN ENSETVPQKSSLEEPDFYKTKIKLCIL-LHAFRIRAVTIDRVMSYLNAS corresponding to amino acids 121-219 of I12A_HUMAN, which also corresponds to amino acids 55-153 of HUMCLMF35_PEA_1_PEA_2_P20, wherein said first amino acid sequence and second amino acid sequence are contiguous and in a sequential order.

2. An isolated chimeric polypeptide for an edge portion of HUMCLMF35_PEA_1_PEA_2_P20, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KA, having a structure as follows: a sequence starting from any of amino acid numbers 54-x to 54; and ending at any of amino acid numbers 55+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCLMF35_PEA_1_PEA_2_P20 also has the following non-silent SNPs (Single Nucleotide Polymorphisms) as listed in Table 322, (given according to their position(s) on the amino acid sequence, with the alternative amino acid(s) listed; the last column indicates whether the SNP is known or not; the presence of known SNPs in variant protein HUMCLMF35_PEA_1_PEA_2_P20 sequence provides support for the deduced sequence of this variant protein according to the present invention).

TABLE 322

Amino acid mutations

| SNP position(s) on amino acid sequence | Alternative amino acid(s) | Previously known SNP? |
|---|---|---|
| 147 | M → T | Yes |

The glycosylation sites of variant protein HUMCLMF35_PEA_1_PEA_2_P20, as compared to the known protein Interleukin-12 alpha chain precursor, are described in Table 323 (given according to their position(s) on the amino acid sequence in the first column; the second column indicates whether the glycosylation site is present in the variant protein; and the last column indicates whether the position is different on the variant protein).

TABLE 323

Glycosylation site(s)

| Position(s) on known amino acid sequence | Present in variant protein? | Position in variant protein? |
|---|---|---|
| 107 | no | |
| 93 | no | |

The variant protein has the following domains, as determined by using InterPro. The domains are described in Table 324:

TABLE 324

InterPro domain(s)

| InterPro ID | Domain description | Analysis type | Position(s) on protein |
|---|---|---|---|
| IPR004281 | Interleukin-12 alpha subunit | HMMPfam | 1-153 |

Variant protein HUMCLMF35_PEA_1_PEA_2_P20 is encoded by the following transcript(s): HUMCLMF35_PEA_1_PEA_2_T10. The coding portion of transcript HUMCLMF35_PEA_1_PEA_2_T10 starts at position 414 and ends at position 872. The transcript also has the following SNPs as listed in Table 325 (given according to their position on the nucleotide sequence, with the alternative nucleic acid listed; the last column indicates whether the SNP is known or not; the presence of known SNPs in variant protein HUMCLMF35_PEA_1_PEA_2_P20 sequence provides support for the deduced sequence of this variant protein according to the present invention).

TABLE 325

Nucleic acid SNPs

| SNP position on nucleotide sequence | Alternative nucleic acid | Previously known SNP? |
|---|---|---|
| 207 | T → C | No |
| 208 | T → A | No |

TABLE 325-continued

Nucleic acid SNPs

| SNP position on nucleotide sequence | Alternative nucleic acid | Previously known SNP? |
|---|---|---|
| 680 | A → G | Yes |
| 845 | T → C | Yes |
| 853 | T → C | Yes |
| 892 | A → | No |
| 966 | G → A | Yes |
| 982 | T → C | Yes |
| 989 | T → A | No |
| 996 | G → A | Yes |

Variant protein HUMCLMF35_PEA_1_PEA_2_P22 according to the present invention is encoded by transcript(s) HUMCLMF35_PEA_1_PEA_2_T12. An alignment is given to the known protein (Interleukin-12 alpha chain precursor) in FIG. 223. One or more alignments to one or more previously published protein sequences are given in FIGS. 218-222. A brief description of the relationship of the variant protein according to the present invention to each such aligned protein is as follows:

Comparison Report Between HUMCLMF35_PEA_1_PEA_2_P22 and I12A_HUMAN:

1. An isolated chimeric polypeptide HUMCLMF35_PEA_1_PEA_2_P22, comprising a first amino acid sequence being at least 90% homologous to MCPARSLLLVATLVLLDHLSLARNLP-VATPDPGMFPCLHHSQNLLRAVSNML QKARQTLE-FYPCTSEEIDHEDITKDKTSTVEA-CLPLELTKNESCLNSRETSFITN GSCLASRKTSFMM corresponding to amino acids 1-120 of I12A_HUMAN, which also corresponds to amino acids 1-120 of HUMCLMF35_PEA_1_PEA_2_P22, and a second amino acid sequence being at least 90% homologous to ALN-FNSETVPQKSSLEEPDFYKTKIKLCIL-LHAFRIRAVTIDRVMSYLNAS corresponding to amino acids 169-219 of I12A_HUMAN, which also corresponds to amino acids 121-171 of HUMCLMF35_PEA_1_PEA_2_P22, wherein said first amino acid sequence and second amino acid sequence are contiguous and in a sequential order.

2. An isolated chimeric polypeptide for an edge portion of HUMCLMF35_PEA_1_PEA_2_P22, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise MA, having a structure as follows: a sequence starting from any of amino acid numbers 120-x to 120; and ending at any of amino acid numbers 121+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCLMF35_PEA_1_PEA_2_P22 also has the following non-silent SNPs (Single Nucleotide Polymorphisms) as listed in Table 326, (given according to their position(s) on the amino acid sequence, with the alternative amino acid(s) listed; the last column indicates whether the SNP is known or not; the presence of known SNPs in variant protein HUMCLMF35_PEA_1_PEA_2_P22 sequence provides support for the deduced sequence of this variant protein according to the present invention).

TABLE 326

Amino acid mutations

| SNP position(s) on amino acid sequence | Alternative amino acid(s) | Previously known SNP? |
|---|---|---|
| 82 | V → A | No |
| 165 | M → T | Yes |

The glycosylation sites of variant protein HUMCLMF35_PEA_1_PEA_2_P22, as compared to the known protein Interleukin-12 alpha chain precursor, are described in Table 327 (given according to their position(s) on the amino acid sequence in the first column; the second column indicates whether the glycosylation site is present in the variant protein; and the last column indicates whether the position is different on the variant protein).

TABLE 327

Glycosylation site(s)

| Position(s) on known amino acid sequence | Present in variant protein? | Position in variant protein? |
|---|---|---|
| 107 | yes | 107 |
| 93 | yes | 93 |

The variant protein has the following domains, as determined by using InterPro. The domains are described in Table 328:

TABLE 328

InterPro domain(s)

| InterPro ID | Domain description | Analysis type | Position(s) on protein |
|---|---|---|---|
| IPR004281 | Interleukin-12 alpha subunit | HMMPfam | 1-171 |

Variant protein HUMCLMF35_PEA_1_PEA_2_P22 is encoded by the following transcript(s): HUMCLMF35_PEA_1_PEA_2_T12. The coding portion of transcript HUMCLMF35_PEA_1_PEA_2_T12 starts at position 414 and ends at position 926. The transcript also has the following SNPs as listed in Table 329 (given according to their position on the nucleotide sequence, with the alternative nucleic acid listed; the last column indicates whether the SNP is known or not; the presence of known SNPs in variant protein HUMCLMF35_PEA_1_PEA_2_P22 sequence provides support for the deduced sequence of this variant protein according to the present invention).

TABLE 329

Nucleic acid SNPs

| SNP position on nucleotide sequence | Alternative nucleic acid | Previously known SNP? |
|---|---|---|
| 207 | T → C | No |
| 208 | T → A | No |

TABLE 329-continued

Nucleic acid SNPs

| SNP position on nucleotide sequence | Alternative nucleic acid | Previously known SNP? |
|---|---|---|
| 658 | T → C | No |
| 899 | T → C | Yes |
| 907 | T → C | Yes |
| 946 | A → | No |
| 1020 | G → A | Yes |
| 1036 | T → C | Yes |
| 1043 | T → A | No |
| 1050 | G → A | Yes |

FIG. 224 depicts the domain structure of the HUM-CLMF35 variants in comparison to the known or wild-type (WT) IL12 protein.

Example 62

Description for Cluster S56892

Cluster S56892 features 4 transcript(s) and 18 segment(s) of interest, the names for which are given in Tables 330 and 331, respectively. The selected protein variants are given in table 332.

TABLE 330

Transcripts of interest

| Transcript Name | SEQ ID NO: |
|---|---|
| S56892_PEA_1_PEA_1_T9 | 934 |
| S56892_PEA_1_PEA_1_T10 | 935 |
| S56892_PEA_1_PEA_1_T13 | 936 |
| S56892_PEA_1_PEA_1_T14 | 937 |

TABLE 331

Segments of interest

| Segment Name | SEQ ID NO: |
|---|---|
| S56892_PEA_1_PEA_1_node_0 | 938 |
| S56892_PEA_1_PEA_1_node_10 | 939 |
| S56892_PEA_1_PEA_1_node_18 | 940 |
| S56892_PEA_1_PEA_1_node_21 | 941 |
| S56892_PEA_1_PEA_1_node_3 | 942 |
| S56892_PEA_1_PEA_1_node_4 | 943 |
| S56892_PEA_1_PEA_1_node_7 | 944 |
| S56892_PEA_1_PEA_1_node_8 | 945 |
| S56892_PEA_1_PEA_1_node_9 | 946 |
| S56892_PEA_1_PEA_1_node_12 | 947 |
| S56892_PEA_1_PEA_1_node_13 | 948 |
| S56892_PEA_1_PEA_1_node_14 | 949 |
| S56892_PEA_1_PEA_1_node_16 | 950 |

TABLE 331-continued

Segments of interest

| Segment Name | SEQ ID NO: |
|---|---|
| S56892_PEA_1_PEA_1_node_17 | 951 |
| S56892_PEA_1_PEA_1_node_19 | 952 |
| S56892_PEA_1_PEA_1_node_20 | 953 |
| S56892_PEA_1_PEA_1_node_22 | 954 |
| S56892_PEA_1_PEA_1_node_23 | 956 |

TABLE 332

Proteins of interest

| Protein Name | SEQ ID NO: | Cooresponding Transcript(s) |
|---|---|---|
| S56892_PEA_1_PEA_1_P8 | 956 | S56892_PEA_1_PEA_1_T9 |
| S56892_PEA_1_PEA_1_P9 | 957 | S56892_PEA_1_PEA_1_T10 |
| S56892_PEA_1_PEA_1_P11 | 958 | S56892_PEA_1_PEA_1_T13 |

These sequences are variants of the known protein Interleukin-6 precursor (SwissProt accession identifier IL6_HUMAN (SEQ ID NO:959); known also according to the synonyms IL-6; B-cell stimulatory factor 2; BSF-2; Interferon beta-2; Hybridoma growth factor; CTL differentiation factor; CDF), referred to herein as the previously known protein.

Protein Interleukin-6 precursor is known or believed to have the following function(s): IL-6 is a cytokine with a wide variety of biological functions: it plays an essential role in the final differentiation of B-cells into Ig-secreting cells, it induces myeloma and plasmacytoma growth, it induces nerve cells differentiation, in hepatocytes it induces acute phase reactants. The sequence for protein Interleukin-6 precursor is given in SEQ ID NO: 959, as "Interleukin-6 precursor amino acid sequence". Known polymorphisms for this sequence are as shown in Table 333.

TABLE 333

Amino acid mutations for Known Protein

| SNP position(s) on amino acid sequence | Comment |
|---|---|
| 32 | P → S./FTId = VAR_013075. |
| 162 | D → V./FTId = VAR_013076. |
| 173 | A → V: ALMOST NO LOSS OF ACTIVITY. |
| 185 | W → R: NO LOSS OF ACTIVITY. |
| 204 | S → P: 87% LOSS OF ACTIVITY. |
| 210 | R → K, E, Q, T, A, P: LOSS OF ACTIVITY. |
| 212 | M → T, N, S, R: LOSS OF ACTIVITY. |

Protein Interleukin-6 precursor localization is believed to be Secreted.

The previously known protein also has the following indication(s) and/or potential therapeutic use(s): Chemotherapy-induced injury; Cancer, sarcoma, Kaposi s; Cancer, myeloma; Chemotherapy-induced injury, bone marrow, thrombocytopenia; Thrombocytopenia; Infection, HIV/AIDS; Chemotherapy-induced injury, bone marrow, neutropenia; Cancer, breast; Cancer, colorectal; Cancer, leukaemia, acute myelogenous; Cancer, melanoma; Myelodysplastic syndrome; Hepatic dysfunction. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Interleukin 1 antagonist; Interleukin 2 agonist; Interleukin 6 modulator. A therapeutic role for a protein represented by the cluster has been predicted. The cluster was assigned this field because there was information in the drug database or the public databases (e.g., described herein above) that this protein, or part thereof, is used or can be used for a potential therapeutic indication: Radio/chemoprotective; Anticancer; Cytokine; Haematological; Anti-inflammatory; Antianaemic; Antiviral, interferon; Anabolic; Hepatoprotective; Antiarthritic, immunological.

The following GO Annotation(s) apply to the previously known protein. The following annotation(s) were found: skeletal development; acute-phase response; humoral defense mechanism; cell surface receptor linked signal transduction; cell-cell signaling; developmental processes; cell proliferation; positive control of cell proliferation; negative control of cell proliferation, which are annotation(s) related to Biological Process; cytokine; interleukin-6 receptor ligand, which are annotation(s) related to Molecular Function; and extracellular space, which are annotation(s) related to Cellular Component.

The GO assignment relies on information from one or more of the SwissProt/TremB1 Protein knowledgebase, or Locuslink.

Interleukin-6 is a pleiotropic cytokine with a wide range of biological activities in immune regulation, hematopoiesis, inflammation and oncogenesis. It acts through two different receptors: IL-6R and a 130 kDa common signal transducer-gp130 to generate a high-affinity complex of IL-6/IL-6R/gp130. It has pathological roles in various disease conditions, including but not limited to inflammatory-mesangial proliferative glomerulonephritis, autoimmune-RA, Psoriasis and malignant diseases-multiple myeloma/plasmacytoma, Kaposi's sarcoma.

FIG. 225 depicts IL6 clinical developments.

As noted above, cluster S56892 features 4 transcript(s), which were listed in Table 330 above. These transcript(s) encode for protein(s) which are variant(s) of protein Interleukin-6 precursor. A description of each variant protein according to the present invention is now provided.

Variant protein S56892_PEA_1_PEA_1_P8 according to the present invention is encoded by transcript(s) S56892_PEA_1_PEA_1_T9. An alignment is given to the known protein (Interleukin-6 precursor) in FIG. 227. One or more alignments to one or more previously published protein sequences are given in FIGS. 228-229. A brief description of the relationship of the variant protein according to the present invention to each such aligned protein is as follows:

Comparison Report Between S56892_PEA_1_PEA_1_P8 and IL6_HUMAN:

1. An isolated chimeric polypeptide S56892_PEA_1_PEA_1_P8, comprising a first amino acid sequence being at least 90% homologous to MNSFSTSAFGPVAFS-LGLLLVLPAAFPAPVPPGEDSKD-VAAPHRQPLTSSERID KQIRYILDGISALRKETCNK-SNMCESSKEALAENNLNLPKMAEKDGCFQSGEN EETCLVKIITGLLEFEVYLEYLQNRFES-SEEQARAVQMSTKVLIQFLQKK corresponding to amino acids 1-157 of IL6_HUMAN, which also corresponds to amino acids 1-157 of S56892_PEA_1_PEA_1_P8, and a second amino acid sequence being at least 70%, optionally at least 80%, preferably at least 85%, more preferably at least 90% and most preferably at least 95% homologous to a polypeptide having the sequence VGVSSF-PQLGVGEDRLKDSVLDNSGMQCHFQKRRLHVNKRV corresponding to amino acids 158-198 of S56892_PEA_1_PEA_1_P8, wherein said first amino acid sequence and second amino acid sequence are contiguous and in a sequential order.

2. An isolated polypeptide for a tail of S56892_PEA_1_PEA_1_P8, comprising a polypeptide being at least 70%, optionally at least about 80%, preferably at least about 85%, more preferably at least about 90% and most preferably at least about 95% homologous to the sequence VGVSSF-PQLGVGEDRLKDSVLDNSGMQCHFQKRRLHVNKRV in S56892_PEA_1_PEA_1_P8.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

The glycosylation sites of variant protein S56892_PEA_1_PEA_1_P8, as compared to the known protein Interleukin-6 precursor, are described in Table 334 (given according to their position(s) on the amino acid sequence in the first column; the second column indicates whether the glycosylation site is present in the variant protein; and the last column indicates whether the position is different on the variant protein).

TABLE 334

| Glycosylation site(s) | | |
|---|---|---|
| Position(s) on known amino acid sequence | Present in variant protein? | Position in variant protein? |
| 73 | yes | 73 |

The variant protein has the following domains, as determined by using InterPro. The domains are described in Table 335:

TABLE 335

| InterPro domain(s) | | | |
|---|---|---|---|
| InterPro ID | Domain description | Analysis type | Position(s) on protein |
| IPR003573 | Interleukin-6/G-CSF/MGF | FPrintScan | 101-126, 56-71, 72-95 |
| IPR003574 | Interleukin-6 | FPrintScan | 101-122, 56-72, 78-100 |
| IPR003573 | Interleukin-6/G-CSF/MGF | HMMPfam | 57-158 |
| IPR003573 | Interleukin-6/G-CSF/MGF | HMMSmart | 57-198 |
| IPR003573 | Interleukin-6/G-CSF/MGF | ScanRegExp | 101-126 |
| IPR003574 | Interleukin-6 | BlastProDom | 46-157 |

Variant protein S56892_PEA_1_PEA_1_P8 is encoded by the following transcript(s): S56892_PEA_1_PEA_1_T9. The coding portion of transcript S56892_PEA_1_PEA_1_T9 starts at position 458 and ends at position 1051. The transcript also has the following SNPs as listed in Table 336 (given according to their position on the nucleotide sequence, with the alternative nucleic acid listed; the last column indicates whether the SNP is known or not; the presence of known SNPs in variant protein S56892_PEA_1_PEA_1_P8 sequence provides support for the deduced sequence of this variant protein according to the present invention).

TABLE 336

Nucleic acid SNPs

| SNP position on nucleotide sequence | Alternative nucleic acid | Previously known SNP? |
|---|---|---|
| 407 | A → T | No |
| 408 | G → T | No |
| 544 | A → G | No |
| 1798 | A → G | Yes |
| 2257 | G → A | Yes |
| 2711 | C → | No |
| 2731 | A → G | No |
| 2792 | G → | No |
| 2805 | C → T | No |
| 3177 | → A | No |
| 3177 | → T | No |

Variant protein S56892_PEA_1_PEA_1_P9 according to the present invention is encoded by transcript(s) S56892_PEA_1_PEA_1_T10. An alignment is given to the known protein (Interleukin-6 precursor) in FIG. 228. One or more alignments to one or more previously published protein sequences are given in FIGS. 227 and 229. A brief description of the relationship of the variant protein according to the present invention to each such aligned protein is as follows:

Comparison Report Between S56892_PEA_1_PEA_1_P9 and IL6_HUMAN:

1. An isolated chimeric polypeptide S56892_PEA_1_PEA_1_P9, comprising a first amino acid sequence being at least 90% homologous to MNSFSTSAFGPVAFS-LGLLLVLPAAFPAPVPPGEDSKD-VAAPHRQPLTSSERID KQIRYILDGISALRKETCNK-SNMCESSKEALAENNLNLPKMAEKDGCFQSGEN E corresponding to amino acids 1-108 of IL6_HUMAN, which also corresponds to amino acids 1-108 of S56892_PEA_1_PEA_1_P9, and a second amino acid sequence being at least 90% homologous to AKNLDAITTPDPTTNASLLT-KLQAQNQWLQDMTTHLILRSFKEFLQSSLRALR QM corresponding to amino acids 158-212 of IL6_HUMAN, which also corresponds to amino acids 109-163 of S56892_PEA_1_PEA_1_P9, wherein said first amino acid sequence and second amino acid sequence are contiguous and in a sequential order.

2. An isolated chimeric polypeptide for an edge portion of S56892_PEA_1_PEA_1_P9, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EA, having a structure as follows: a sequence starting from any of amino acid numbers 108-x to 108; and ending at any of amino acid numbers 109+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein S56892_PEA_1_PEA_1_P9 also has the following non-silent SNPs (Single Nucleotide Polymorphisms) as listed in Table 337, (given according to their position(s) on the amino acid sequence, with the alternative amino acid(s) listed; the last column indicates whether the SNP is known or not; the presence of known SNPs in variant protein S56892_PEA_1_PEA_1_P9 sequence provides support for the deduced sequence of this variant protein according to the present invention).

TABLE 337

Amino acid mutations

| SNP position(s) on amino acid sequence | Alternative amino acid(s) | Previously known SNP? |
|---|---|---|
| 121 | T → | No |
| 128 | T → A | No |
| 148 | S → | No |

The glycosylation sites of variant protein S56892_PEA_1_PEA_1_P9, as compared to the known protein Interleukin-6 precursor, are described in Table 338 (given according to their position(s) on the amino acid sequence in the first column; the second column indicates whether the glycosylation site is present in the variant protein; and the last column indicates whether the position is different on the variant protein).

TABLE 338

Glycosylation site(s)

| Position(s) on known amino acid sequence | Present in variant protein? | Position in variant protein? |
|---|---|---|
| 73 | yes | 73 |

The variant protein has the following domains, as determined by using InterPro. The domains are described in Table 339:

TABLE 339

InterPro domain(s)

| InterPro ID | Domain description | Analysis type | Position(s) on protein |
|---|---|---|---|
| IPR003573 | Interleukin-6/G-CSF/MGF | FPrintScan | 101-126, 56-71, 72-95 |
| IPR003574 | Interleukin-6 | FPrintScan | 101-122, 56-72, 78-100 |
| IPR003573 | Interleukin-6/G-CSF/MGF | HMMPfam | 110-161, 57-109 |
| IPR003573 | Interleukin-6/G-CSF/MGF | HMMSmart | 57-161 |
| IPR003574 | Interleukin-6 | BlastProDom | 46-163 |

Variant protein S56892_PEA_1_PEA_1_P9 is encoded by the following transcript(s): S56892_PEA_1_PEA_1_T10. The coding portion of transcript S56892_PEA_1_PEA_1_T10 starts at position 113 and ends at position 601. The transcript also has the following SNPs as listed in Table 340 (given according to their position on the nucleotide sequence, with the alternative nucleic acid listed; the last column indicates whether the SNP is known or not; the presence of known SNPs in variant protein S56892_PEA_1_PEA_1_P9 sequence provides support for the deduced sequence of this variant protein according to the present invention).

TABLE 340

Nucleic acid SNPs

| SNP position on nucleotide sequence | Alternative nucleic acid | Previously known SNP? |
|---|---|---|
| 62 | A → T | No |
| 63 | G → T | No |
| 199 | A → G | No |
| 474 | C → | No |
| 494 | A → G | No |
| 555 | G → | No |
| 568 | C → T | No |
| 940 | → A | No |
| 940 | → T | No |

Variant protein S56892_PEA_1_PEA_1_P11 according to the present invention is encoded by transcript(s) S56892_PEA_1_PEA_1_T13. An alignment is given to the known protein (Interleukin-6 precursor) in FIG. 229. One or more alignments to one or more previously published protein sequences are given in FIGS. 227-228. A brief description of the relationship of the variant protein according to the present invention to each such aligned protein is as follows:

Comparison Report Between S56892_PEA_1_PEA_1_P11 and IL6_HUMAN:

1. An isolated chimeric polypeptide S56892_PEA_1_PEA_1_P11, comprising a first amino acid sequence being at least 90% homologous to MNSFSTSAFGPVAFS-LGLLLVLPAAFPAPVPPGEDSKD-VAAPHRQPLTSSERID KQIRYILDGISALRKETCNKSN corresponding to amino acids 1-76 of IL6_HUMAN, which also corresponds to amino acids 1-76 of S56892_PEA_1_PEA_1_P11, and a second amino acid sequence being at least 70%, optionally at least 80%, preferably at least 85%, more preferably at least 90% and most preferably at least 95% homologous to a polypeptide having the sequence IWLKK-MDASNLDSMRRLAW corresponding to amino acids 77-95 of S56892_PEA_1_PEA_1_P11, wherein said first amino acid sequence and second amino acid sequence are contiguous and in a sequential order.

2. An isolated polypeptide for a tail of S56892_PEA_1_PEA_1_P11, comprising a polypeptide being at least 70%, optionally at least about 80%, preferably at least about 85%, more preferably at least about 90% and most preferably at least about 95% homologous to the sequence IWLKKM-DASNLDSMRRLAW in S56892_PEA_1_PEA_1_P11.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

The glycosylation sites of variant protein S56892_PEA_1_PEA_1_P11, as compared to the known protein Interleukin-6 precursor, are described in Table 341 (given according to their position(s) on the amino acid sequence in the first column; the second column indicates whether the glycosylation site is present in the variant protein; and the last column indicates whether the position is different on the variant protein).

TABLE 341

Glycosylation site(s)

| Position(s) on known amino acid sequence | Present in variant protein? | Position in variant protein? |
|---|---|---|
| 73 | yes | 73 |

The variant protein has the following domains, as determined by using InterPro. The domains are described in Table 342:

TABLE 342

InterPro domain(s)

| InterPro ID | Domain description | Analysis type | Position(s) on protein |
|---|---|---|---|
| IPR003573 | Interleukin-6/G-CSF/MGF | HMMPfam | 57-76 |
| IPR003574 | Interleukin-6 | BlastProDom | 46-77 |

Variant protein S56892_PEA_1_PEA_1_P11 is encoded by the following transcript(s): S56892_PEA_1_PEA_1_T13. The coding portion of transcript S56892_PEA_1_PEA_1_T13 starts at position 459 and ends at position 739. The transcript also has the following SNPs as listed in Table 343 (given according to their position on the nucleotide sequence, with the alternative nucleic acid listed; the last column indicates whether the SNP is known or not; the presence of known SNPs in variant protein S56892_PEA_1_PEA_1_P11 sequence provides support for the deduced sequence of this variant protein according to the present invention).

TABLE 343

Nucleic acid SNPs

| SNP position on nucleotide sequence | Alternative nucleic acid | Previously known SNP? |
|---|---|---|
| 407 | A → T | No |
| 408 | G → T | No |
| 544 | A → G | No |
| 914 | C → | No |
| 934 | A → G | No |
| 995 | G → | No |
| 1008 | C → T | No |
| 1380 | → A | No |
| 1380 | → T | No |

FIG. 226 depicts the domain structure of the variants described hereinabove in comparison to the known or wild-type (WT) IL6 protein.

Example 63

Description for Cluster HUMTGFBIIR

Cluster HUMTGFBIIR features 2 transcript(s) and 10 segment(s) of interest, the names for which are given in Tables 344 and 345, respectively. The selected protein variants are given in table 346.

TABLE 344

Transcripts of interest

| Transcript Name | SEQ ID NO: |
|---|---|
| HUMTGFBIIR_PEA_1T4 | 960 |
| HUMTGFBIIR_PEA_1_T11 | 961 |

TABLE 345

Segments of interest

| Segment Name | SEQ ID NO: |
|---|---|
| HUMTGFBIIR_PEA_1_node_1 | 962 |
| HUMTGFBIIR_PEA_1_node_2 | 963 |
| HUMTGFBIIR_PEA_1_node_14 | 964 |
| HUMTGFBIIR_PEA_1_node_17 | 965 |
| HUMTGFBIIR_PEA_1_node_18 | 966 |
| HUMTGFBIIR_PEA_1_node_20 | 967 |
| HUMTGFBIIR_PEA_1_node_25 | 968 |
| HUMTGFBIIR_PEA_1_node_28 | 969 |
| HUMTGFBIIR_PEA_1_node_31 | 970 |
| HUMTGFBIIR_PEA_1_node_33 | 971 |

TABLE 346

Proteins of interest

| Protein Name | SEQ ID NO: | Protein Length | Corresponding Transcript(s) |
|---|---|---|---|
| HUMTGFBIIR_PEA_1_P9 | 972 | P176 | HUMTGFBIIR_PEA_1_T11 |
| HUMTGFBIIR_PEA_1_P14 | 973 | P156 | HUMTGFBIIR_PEA_1_T4 |

These sequences are variants of the known protein TGF-beta receptor type II precursor (SwissProt accession identifier TGR2_HUMAN SEQ ID NO:974; known also according to the synonyms EC 2.7.1.37; TGFR-2; TGF-beta type II receptor), referred to herein as the previously known protein.

Protein TGF-beta receptor type II precursor is known or believed to have the following function(s): Type I/type II TGF-beta receptors form an heteromeric complex after binding TGF-beta at the cell surface and act as signal transducers. The sequence for protein TGF-beta receptor type II precursor is given in SEQ ID NO: 974, as "TGF-beta receptor type II precursor amino acid sequence". Known polymorphisms for this sequence are as shown in Table 347.

TABLE 347

Amino acid mutations for Known Protein

| SNP position(s) on amino acid sequence | Comment |
|---|---|
| 191 | V → L/FTId = VAR_017606. |
| 315 | T → M (in HNPCC6)./FTId = VAR_008156. |

TABLE 347-continued

Amino acid mutations for Known Protein

| SNP position(s) on amino acid sequence | Comment |
|---|---|
| 526 | E → Q (in esophageal cancer)./FTId = VAR_015816. |
| 277 | K → R: Abolishes kinase activity, TGF-beta signaling and interaction with DAXX. |
| 381 | K → N |

Protein TGF-beta receptor type II precursor localization is believed to be Type I membrane protein.

The previously known protein also has the following indication(s) and/or potential therapeutic use(s): Cancer, breast; Cancer, colorectal; Multiple sclerosis; Eczema; Lupus erythematosus; Psoriasis. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein or of drugs directed against this protein are as follows: Transforming growth factor beta 3 agonist; Transforming growth factor beta agonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Vulnerary; Cytokine; Musculoskeletal; Anticancer; Antidiabetic; Antipruritic/inflamm, allergic; Antipsoriasis; Multiple sclerosis.

The following GO Annotation(s) apply to the previously known protein. The following annotation(s) were found: protein amino acid phosphorylation; transmembrane receptor protein serine/threonine kinase signaling pathway; TGFbeta ligand binding to type II receptor; positive control of cell proliferation, which are annotation(s) related to Biological Process; receptor; type II transforming growth factor beta receptor; ATP binding; transferase, which are annotation(s) related to Molecular Function; and integral membrane protein, which are annotation(s) related to Cellular Component.

The GO assignment relies on information from one or more of the SwissProt/TremB1 Protein knowledgebase, or Locuslink.

As noted above, cluster HUMTGFBIIR features 2 transcript(s), which were listed in Table 344 above. These transcript(s) encode for protein(s) which are variant(s) of protein TGF-beta receptor type II precursor. A description of each variant protein according to the present invention is now provided.

Variant protein HUMTGFBIIR_PEA__1_P9 according to the present invention is encoded by transcript(s) HUMTGFBIIR_PEA__1_T11. An alignment is given to the known protein (TGF-beta receptor type II precursor) in FIG. 230. One or more alignments to one or more previously published protein sequences are given in FIG. 231. A brief description of the relationship of the variant protein according to the present invention to each such aligned protein is as follows:

Comparison Report Between HUMTGFBIIR_PEA__1_P9 and TGR2_HUMAN:

1. An isolated chimeric polypeptide HUMTGFBIIR_PEA__1_P9, comprising a first amino acid sequence being at least 90% homologous to MGRGLLRGLWPLHIVLWTRI-ASTIPPHVQKSVNNDMIVTDNNGAVKFPQLCK FCD-VRFSTCDNQKSCMSNCSITSICEK-PQEVCVAVWRKNDENITLETVCHDPK LPYHDFILEDAASPKCIMKEKKKPGET-FFMCSCSSDECNDNIIFSE corresponding to amino acids 1-151 of TGR2_HUMAN, which also corresponds to amino acids 1-151 of HUMTGFBIIR_PEA_1_P9, and a second amino acid sequence being at least 70%, optionally at least 80%, preferably at least 85%, more preferably at least 90% and most preferably at least 95% homologous to a polypeptide having the sequence GEFSSLKGVGPEICANFLYPWSAVS corresponding to amino acids 152-176 of HUMTGFBIIR_PEA_1_P9, wherein said first amino acid sequence and second amino acid sequence are contiguous and in a sequential order.

2. An isolated polypeptide for a tail of HUMTGFBIIR_PEA_1_P9, comprising a polypeptide being at least 70%, optionally at least 80%, preferably at least 85%, more preferably at least 90% and most preferably at least about 95% homologous to the sequence GEFSSLKGVGPEICANFLYPWSAVS in HUMTGFBIIR_PEA_1_P9.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTGFBIIR_PEA_1_P9 also has the following non-silent SNPs (Single Nucleotide Polymorphisms) as listed in Table 348, (given according to their position(s) on the amino acid sequence, with the alternative amino acid(s) listed; the last column indicates whether the SNP is known or not; the presence of known SNPs in variant protein HUMTGFBIIR_PEA_1_P9 sequence provides support for the deduced sequence of this variant protein according to the present invention).

TABLE 348

Amino acid mutations

| SNP position(s) on amino acid sequence | Alternative amino acid(s) | Previously known SNP? |
|---|---|---|
| 8 | G → C | No |
| 8 | G → S | No |
| 125 | E → | No |

The glycosylation sites of variant protein HUMTGFBIIR_PEA_1_P9, as compared to the known protein TGF-beta receptor type II precursor, are described in Table 349 (given according to their position(s) on the amino acid sequence in the first column; the second column indicates whether the glycosylation site is present in the variant protein; and the last column indicates whether the position is different on the variant protein).

TABLE 349

Glycosylation site(s)

| Position(s) on known amino acid sequence | Present in variant protein? | Position in variant protein? |
|---|---|---|
| 94 | yes | 94 |
| 70 | yes | 70 |
| 154 | no | |

The variant protein has the following domains, as determined by using InterPro. The domains are described in Table 350:

TABLE 350

InterPro domain(s)

| InterPro ID | Domain description | Analysis type | Position(s) on protein |
|---|---|---|---|
| IPR000472 | TGF-beta receptor/activin receptor, type I/II | ProfileScan | 77-147 |

Variant protein HUMTGFBIIR_PEA_1_P9 is encoded by the following transcript(s): HUMTGFBIIR_PEA_1_T11. The coding portion of transcript HUMTGFBIIR_PEA_1_T11 starts at position 432 and ends at position 959. The transcript also has the following SNPs as listed in Table 351 (given according to their position on the nucleotide sequence, with the alternative nucleic acid listed; the last column indicates whether the SNP is known or not; the presence of known SNPs in variant protein HUMTGFBIIR_PEA_1_P9 sequence provides support for the deduced sequence of this variant protein according to the present invention).

TABLE 351

Nucleic acid SNPs

| SNP position on nucleotide sequence | Alternative nucleic acid | Previously known SNP? |
|---|---|---|
| 46 | A → T | No |
| 301 | C → G | Yes |
| 453 | G → A | No |
| 453 | G → T | No |
| 805 | A → | No |
| 959 | A → G | Yes |
| 1051 | G → C | Yes |
| 1152 | T → C | Yes |
| 1163 | C → T | Yes |
| 1364 | T → C | Yes |
| 1384 | C → T | Yes |

Variant protein HUMTGFBIIR_PEA_1_P14 according to the present invention is encoded by transcript(s) HUMTGFBIIR_PEA_1_T4. An alignment is given to the known protein (TGF-beta receptor type II precursor) in FIG. 231. One or more alignments to one or more previously published protein sequences are given in FIG. 230. A brief description of the relationship of the variant protein according to the present invention to each such aligned protein is as follows:

Comparison Report Between HUMTGFBIIR_PEA_1_P14 and TGR2_HUMAN:

1. An isolated chimeric polypeptide HUMTGFBIIR_PEA_1_P14, comprising a first amino acid sequence being at least 90% homologous to MGRGLLRGLWPLHIVLWTRIASTIPPHVQKSVNNDMIVTDNNGAVKFPQLCK FCDVRFSTCDNQKSCMSNCSITSICEK-PQEVCVAVWRKNDENITLETVCHDPK LPYHDFILEDAASPKCIMKEKKKPGET-FFMCSCSSDECNDNIIFSE corresponding to amino acids 1-151 of TGR2_HUMAN, which also corresponds to amino acids 1-151 of HUMTGFBIIR_PEA_1_P14, and a second amino acid sequence being at least 70%, optionally at least 80%, preferably at least 85%, more preferably at least 90% and most preferably at least 95% homologous to a polypeptide having the sequence DFLMK corresponding to amino acids 152-156 of HUMTGFBIIR_PEA_1_P14, wherein said first amino acid sequence and second amino acid sequence are contiguous and in a sequential order.

2. An isolated polypeptide for a tail of HUMTGFBIIR_PEA_1_P14, comprising a polypeptide being at least 70%, optionally at least about 80%, preferably at least about 85%, more preferably at least about 90% and most preferably at least about 95% homologous to the sequence DFLMK in HUMTGFBIIR_PEA_1_P14.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTGFBIIR_PEA_1_P14 also has the following non-silent SNPs (Single Nucleotide Polymorphisms) as listed in Table 352, (given according to their position(s) on the amino acid sequence, with the alternative amino acid(s) listed; the last column indicates whether the SNP is known or not; the presence of known SNPs in variant protein HUMTGFBIIR_PEA_1_P14 sequence provides support for the deduced sequence of this variant protein according to the present invention).

TABLE 352

Amino acid mutations

| SNP position(s) on amino acid sequence | Alternative amino acid(s) | Previously known SNP? |
|---|---|---|
| 8 | G → C | No |
| 8 | G → S | No |
| 125 | E → | No |

The glycosylation sites of variant protein HUMTGFBIIR_PEA_1_P14, as compared to the known protein TGF-beta receptor type II precursor, are described in Table 353 (given according to their position(s) on the amino acid sequence in the first column; the second column indicates whether the glycosylation site is present in the variant protein; and the last column indicates whether the position is different on the variant protein).

TABLE 353

Glycosylation site(s)

| Position(s) on known amino acid sequence | Present in variant protein? | Position in variant protein? |
|---|---|---|
| 94 | yes | 94 |
| 70 | yes | 70 |
| 154 | no | |

The variant protein has the following domains, as determined by using InterPro. The domains are described in Table 354:

TABLE 354

InterPro domain(s)

| InterPro ID | Domain description | Analysis type | Position(s) on protein |
|---|---|---|---|
| IPR000472 | TGF-beta receptor/activin receptor, type I/II | ProfileScan | 77-147 |

Variant protein HUMTGFBIIR_PEA_1_P14 is encoded by the following transcript(s): HUMTGFBIIR_PEA_1_T4. The coding portion of transcript HUMTGFBIIR_PEA_1_T4 starts at position 432 and ends at position 899. The transcript also has the following SNPs as listed in Table 355 (given according to their position on the nucleotide sequence, with the alternative nucleic acid listed; the last column indicates whether the SNP is known or not; the presence of known SNPs in variant protein HUMTGFBIIR_PEA_1_P14 sequence provides support for the deduced sequence of this variant protein according to the present invention).

TABLE 355

Nucleic acid SNPs

| SNP position on nucleotide sequence | Alternative nucleic acid | Previously known SNP? |
|---|---|---|
| 46 | A → T | No |
| 301 | C → G | Yes |
| 453 | G → A | No |
| 453 | G → T | No |
| 805 | A → | No |
| 1037 | T → G | No |
| 1138 | C → T | No |
| 1227 | C → | No |
| 1454 | A → T | No |
| 1455 | G → T | No |
| 1502 | A → T | Yes |
| 1554 | A → G | Yes |
| 1705 | A → | No |
| 1705 | A → C | No |
| 1722 | C → T | Yes |
| 1821 | A → G | Yes |
| 1871 | T → C | Yes |
| 1903 | A → G | No |
| 1930 | T → G | No |
| 1944 | A → C | No |
| 2587 | C → A | Yes |
| 2932 | T → C | No |
| 3004 | C → G | Yes |
| 3611 | C → T | Yes |
| 3778 | G → A | Yes |
| 3946 | A → T | Yes |
| 4066 | A → G | Yes |
| 4090 | A → C | Yes |
| 4137 | G → A | Yes |
| 4143 | G → T | Yes |
| 4322 | C → T | Yes |
| 4342 | T → A | Yes |
| 4394 | → C | No |
| 4486 | T → | No |
| 4504 | → T | No |
| 4561 | → T | No |
| 4573 | C → G | Yes |
| 4633 | A → C | No |
| 4708 | T → G | No |

FIG. 232 depicts the domain structure of the variants described hereinabove in comparison to the known or wild-type (WT) TGR2_HUMAN protein.

Example 64

Description for Cluster HUMGCSF

Cluster HUMGCSF features 14 transcript(s) and 11 segment(s) of interest, the names for which are given in Tables 356 and 357, respectively, the sequences themselves are given in the sequence listing. The selected protein variants are given in Table 358.

TABLE 356

Transcripts of interest

| Transcript Name | SEQ ID NO: |
|---|---|
| HUMGCSF_PEA_1_T4 | 975 |
| HUMGCSF_PEA_1_T5 | 976 |
| HUMGCSF_PEA_1_T6 | 977 |
| HUMGCSF_PEA_1_T7 | 978 |
| HUMGCSF_PEA_1_T8 | 979 |
| HUMGCSF_PEA_1_T13 | 980 |
| HUMGCSF_PEA_1_T14 | 981 |
| HUMGCSF_PEA_1_T16 | 982 |
| HUMGCSF_PEA_1_T17 | 983 |
| HUMGCSF_PEA_1_T18 | 984 |
| HUMGCSF_PEA_1_T19 | 985 |
| HUMGCSF_PEA_1_T20 | 986 |
| HUMGCSF_PEA_1_T21 | 987 |
| HUMGCSF_PEA_1_T22 | 988 |

TABLE 357

Segments of interest

| Segment Name | SEQ ID NO: |
|---|---|
| HUMGCSF_PEA_1_node_0 | 989 |
| HUMGCSF_PEA_1_node_1 | 990 |
| HUMGCSF_PEA_1_node_2 | 991 |
| HUMGCSF_PEA_1_node_8 | 992 |
| HUMGCSF_PEA_1_node_9 | 993 |
| HUMGCSF_PEA_1_node_11 | 994 |
| HUMGCSF_PEA_1_node_13 | 995 |
| HUMGCSF_PEA_1_node_3 | 996 |
| HUMGCSF_PEA_1_node_7 | 997 |
| HUMGCSF_PEA_1_node_10 | 998 |
| HUMGCSF_PEA_1_node_12 | 999 |

TABLE 358

Proteins of interest

| Protein Name | SEQ ID NO: | Protein Length | Corresponding Transcript(s) |
|---|---|---|---|
| HUMGCSF_PEA_1_P5 | 1000 | P151 | HUMGCSF_PEA_1_T4 |
| HUMGCSF_PEA_1_P6 | 1001 | P110 | HUMGCSF_PEA_1_T5 |
| HUMGCSF_PEA_1_P7 | 1002 | P190 | HUMGCSF_PEA_1_T6 |
| HUMGCSF_PEA_1_P8 | 1003 | P147 | HUMGCSF_PEA_1_T7 |
| HUMGCSF_PEA_1_P9 | 1004 | P168 | HUMGCSF_PEA_1_T8; HUMGCSF_PEA_1_T21 |
| HUMGCSF_PEA_1_P13 | 1005 | P171 | HUMGCSF_PEA_1_T13; HUMGCSF_PEA_1_T20 |
| HUMGCSF_PEA_1_P14 | 1006 | P103 | HUMGCSF_PEA_1_T14 |
| HUMGCSF_PEA_1_P16 | 1007 | P154 | HUMGCSF_PEA_1_T16 |
| HUMGCSF_PEA_1_P18 | 1008 | P187 | HUMGCSF_PEA_1_T18 |
| HUMGCSF_PEA_1_P19 | 1009 | P150 | HUMGCSF_PEA_1_T19 |
| HUMGCSF_PEA_1_P20 | 1010 | P106 | HUMGCSF_PEA_1_T22 |
| HUMGCSF_PEA_1_P21 | 1011 | P107 | HUMGCSF_PEA_1_T17 |

These sequences are variants of the known protein Granulocyte colony-stimulating factor precursor (SwissProt accession identifier CSF3_HUMAN; SEQ ID NO:128; known also according to the synonyms G-CSF; Pluripoietin; Filgrastim; Lenograstim), referred to herein as the previously known protein.

Protein Granulocyte colony-stimulating factor precursor is known or believed to have the following function(s): Granulocyte/macrophage colony-stimulating factors are cytokines that act in hematopoiesis by controlling the production, differentiation, and function of 2 related white cell populations of the blood, the granulocytes and the monocytes-macrophages. This CSF induces granulocytes. The sequence for protein Granulocyte colony-stimulating factor precursor is set forth in SEQ ID NO:128, as "Granulocyte colony-stimulating factor precursor amino acid sequence". Known polymorphisms for this sequence are as shown in Table 359.

TABLE 359

Amino acid mutations for Known Protein

| SNP position(s) on amino acid sequence | Comment |
|---|---|
| 157 | L → M./FTId = VAR_013073. |
| 174 | A → T./FTId = VAR_013074. |

Protein Granulocyte colony-stimulating factor precursor localization is believed to be Secreted.

The previously known protein also has the following indication(s) and/or potential therapeutic use(s): Anaemia; Chemotherapy-induced injury, bone marrow; Chemotherapy-induced injury, bone marrow, neutropenia; Neutropenia; Chemotherapy-induced injury, bone marrow, leucopenia; Leucopenia; Cancer. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein or of drugs directed against this protein are as follows: Colony stimulating factor agonist; Granulocyte stimulating factor agonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Radio/chemoprotective; Cytokine; Immunomodulator, anti-infective; Haematological; Anti-anaemic; Anticancer; Immunostimulant, anti-AIDS.

The following GO Annotation(s) apply to the previously known protein. The following annotation(s) were found: immune response; cellular defense response; cell surface receptor linked signal transduction; cell-cell signaling; developmental processes; positive control of cell proliferation, which are annotation(s) related to Biological Process; cytokine; granulocyte colony stimulating factor receptor ligand; interleukin-6 receptor ligand, which are annotation(s) related to Molecular Function; and extracellular; extracellular space, which are annotation(s) related to Cellular Component.

The GO assignment relies on information from one or more of the SwissProt/TremB1 Protein knowledgebase, or Locuslink.

G-CSF Granulocyte Colony-Stimulating Factor has the following biological activities (intended as non-limiting examples only): stimulation of granulocyte proliferation, differentiation and survival; mobilization of hematopoietic stem cells into the peripheral blood circulation. It is secreted mainly by monocytes and macrophages but also by fibroblasts, endothelial cells, T-lymphocytes and polymorphonuclear granulocytes The GCSF Receptor is a type I receptor that functions as a homodimer; it does not posses TK activity and is primarily expressed on neutrophilic progenitors and mature neutrophils.

FIGS. 233-235 depict the GCSF launched products (FIG. 233), GCSF clinical developments (FIG. 234) and GCSF preclinical developments (FIG. 235).

As noted above, cluster HUMGCSF features 14 transcript(s), which were listed in Table 1 above. These transcript(s) encode for protein(s) which are variant(s) of protein Granulocyte colony-stimulating factor precursor. A description of each variant protein according to the present invention is now provided.

Variant protein HUMGCSF_PEA_1_P5 (SEQ ID NO:1000) is encoded by transcript(s) HUMGCSF_PEA_1_T4. An alignment is given to the known protein (Granulocyte colony-stimulating factor precursor; SEQ ID NO:128) in FIG. 237. One or more alignments to one or more previously published protein sequences are given in FIGS. 237-251. A brief description of the relationship of the variant protein according to the present invention to each such aligned protein is as follows:

Comparison Report Between HUMGCSF_PEA_1_P5 and CSF3_HUMAN:

1. An isolated chimeric polypeptide HUMGCSF_PEA_1_P5, comprising a first amino acid sequence being at least 90% homologous to MAGPATQSPMKLMALQLLLWH-SALWTVQEATPLGPASSLPQSFLLKCLEQV RKIQGD-GAALQEK corresponding to amino acids 1-64 of CSF3_HUMAN, which also corresponds to amino acids 1-64 of HUMGCSF_PEA_1_P5, a second amino acid sequence being at least 90% homologous to LAGCLSQLHSGLFLY-QGLLQALEGISPELGPTLDTLQLDVADFATTIWQQ corresponding to amino acids 104-153 of CSF3_HUMAN, which also corresponds to amino acids 65-114 of HUMGC-SF_PEA_1_P5, and a third amino acid sequence being at least 70%, optionally at least 80%, preferably at least 85%, more preferably at least 90% and most preferably at least 95% homologous to a polypeptide having the sequence VSLVGQGGQGRAGILGTTAGPVYGPCPCCQPPAFPHL corresponding to amino acids 115-151 of HUMGCSF_PEA_1_P5, wherein said first amino acid sequence, second amino acid sequence and third amino acid sequence are contiguous and in a sequential order.

2. An isolated chimeric polypeptide for an edge portion of HUMGCSF_PEA_1_P5, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KL, having a structure as follows: a sequence starting from any of amino acid numbers 64-x to 64; and ending at any of amino acid numbers 65+((n−2)−x), in which x varies from 0 to n−2.

3. An isolated polypeptide for a tail of HUMGCSF_PEA_1_P5, comprising a polypeptide being at least 70%, optionally at least about 80%, preferably at least about 85%, more preferably at least about 90% and most preferably at least about 95% homologous to the sequence VSLVGQG-GQGRAGILGTTAGPVYGPCPCCQPPAFPHL in HUMGCSF_PEA_1_P5.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGCSF_PEA_1_P5 also has the following non-silent SNPs (Single Nucleotide Polymorphisms) as listed in Table 360, (given according to their position(s) on the amino acid sequence, with the alternative amino acid(s) listed; the last column indicates whether the SNP is known or not; the presence of known SNPs in variant protein HUMGCSF_PEA_1_P5 sequence provides support for the deduced sequence of this variant protein according to the present invention).

TABLE 360

Amino acid mutations

| SNP position(s) on amino acid sequence | Alternative amino acid(s) | Previously known SNP? |
|---|---|---|
| 31 | T → | No |
| 60 | A → P | No |
| 60 | A → | No |
| 80 | Q → | No |
| 94 | G → C | No |
| 109 | T → A | No |
| 112 | W → R | No |
| 134 | G → R | Yes |
| 145 | P → A | Yes |

The glycosylation sites of variant protein HUMGCSF_PEA_1_P5, as compared to the known protein Granulocyte colony-stimulating factor precursor, are described in Table 361 (given according to their position(s) on the amino acid sequence in the first column; the second column indicates whether the glycosylation site is present in the variant protein; and the last column indicates whether the position is different on the variant protein).

TABLE 361

| Glycosylation site(s) | | |
|---|---|---|
| Position(s) on known amino acid sequence | Present in variant protein? | Position in variant protein? |
| 166 | no | |

The variant protein has the following domains, as determined by using InterPro. The domains are described in Table 362:

TABLE 362

| InterPro domain(s) | | | |
|---|---|---|---|
| InterPro ID | Domain description | Analysis type | Position(s) on protein |
| IPR003573 | Interleukin-6/G-CSF/MGF | HMMSmart | 51-137 |
| IPR003629 | Granulocyte colony-stimulating/myelomonocytic growth factor | BlastProDom | 33-112 |

Variant protein HUMGCSF_PEA_1_P5 is encoded by the following transcript(s): HUMGCSF_PEA_1_T4 (SEQ ID NO:975). The coding portion of transcript HUMGCSF_PEA_1_T4 starts at position 115 and ends at position 567. The transcript also has the following SNPs as listed in Table 363 (given according to their position on the nucleotide sequence, with the alternative nucleic acid listed; the last column indicates whether the SNP is known or not; the presence of known SNPs in variant protein HUMGCSF_PEA_1_P5 sequence provides support for the deduced sequence of this variant protein according to the present invention).

TABLE 363

| Nucleic acid SNPs | | |
|---|---|---|
| SNP position on nucleotide sequence | Alternative nucleic acid | Previously known SNP? |
| 55 | C → G | Yes |
| 99 | A → G | Yes |
| 206 | C → | No |
| 292 | G → | No |
| 292 | G → C | No |
| 354 | G → | No |
| 394 | G → T | No |
| 439 | A → G | No |
| 448 | T → C | No |
| 514 | G → A | Yes |
| 547 | C → G | Yes |
| 622 | T → C | No |
| 630 | C → A | Yes |
| 662 | G → | No |
| 681 | G → A | Yes |
| 716 | A → G | Yes |
| 842 | G → A | No |
| 926 | C → T | Yes |
| 1007 | A → G | Yes |
| 1058 | T → C | No |
| 1062 | C → | No |
| 1238 | C → | No |
| 1278 | C → | No |
| 1310 | C → T | Yes |
| 1365 | T → C | Yes |

TABLE 363-continued

| Nucleic acid SNPs | | |
|---|---|---|
| SNP position on nucleotide sequence | Alternative nucleic acid | Previously known SNP? |
| 1405 | G → A | Yes |
| 1475 | C → T | Yes |

Variant protein HUMGCSF_PEA_1_P6 (SEQ ID NO:1001) according to the present invention is encoded by transcript(s) HUMGCSF_PEA_1_T5. An alignment is given to the known protein (Granulocyte colony-stimulating factor precursor) in FIG. 238. One or more alignments to one or more previously published protein sequences are given in FIGS. 237-251. A brief description of the relationship of the variant protein according to the present invention to each such aligned protein is as follows:

Comparison Report Between HUMGCSF_PEA_1_P6 and CSF3_HUMAN:

1. An isolated chimeric polypeptide HUMGCSF_PEA_1_P6, comprising a first amino acid sequence being at least 90% homologous to MAGPATQSPMKLMALQLLLWH-SALWTVQEATPLGPASSLPQSFLLKCLEQV RKIQGD-GAALQEKLVSECATYKLCHPEELVLLGH-SLGIPWAPLSSCPSQALQL corresponding to amino acids 1-104 of CSF3_HUMAN, which also corresponds to amino acids 1-104 of HUMGCSF_PEA_1_P6, and a second amino acid sequence being at least 70%, optionally at least 80%, preferably at least 85%, more preferably at least 90% and most preferably at least 95% homologous to a polypeptide having the sequence VSVRKG corresponding to amino acids 105-110 of HUMGCSF_PEA_1_P6, wherein said first amino acid sequence and second amino acid sequence are contiguous and in a sequential order.

2. An isolated polypeptide for a tail of HUMGCSF_PEA_1_P6, comprising a polypeptide being at least 70%, optionally at least about 80%, preferably at least about 85%, more preferably at least about 90% and most preferably at least about 95% homologous to the sequence VSVRKG in HUMGCSF_PEA_1_P6.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGCSF_PEA_1_P6 also has the following non-silent SNPs (Single Nucleotide Polymorphisms) as listed in Table 364, (given according to their position(s) on the amino acid sequence, with the alternative amino acid(s) listed; the last column indicates whether the SNP is known or not; the presence of known SNPs in variant protein HUMGCSF_PEA_1_P6 sequence provides support for the deduced sequence of this variant protein according to the present invention).

TABLE 364

Amino acid mutations

| SNP position(s) on amino acid sequence | Alternative amino acid(s) | Previously known SNP? |
| --- | --- | --- |
| 31 | T → | No |
| 60 | A → | No |
| 60 | A → P | No |

The glycosylation sites of variant protein HUMGCSF_PEA_1_P6, as compared to the known protein Granulocyte colony-stimulating factor precursor, are described in Table 365 (given according to their position(s) on the amino acid sequence in the first column; the second column indicates whether the glycosylation site is present in the variant protein; and the last column indicates whether the position is different on the variant protein).

TABLE 365

Glycosylation site(s)

| Position(s) on known amino acid sequence | Present in variant protein? | Position in variant protein? |
| --- | --- | --- |
| 166 | no | |

The variant protein has the following domains, as determined by using InterPro. The domains are described in Table 366:

TABLE 366

InterPro domain(s)

| InterPro ID | Domain description | Analysis type | Position(s) on protein |
| --- | --- | --- | --- |
| IPR003573 | Interleukin-6/G-CSF/MGF | FPrintScan | 50-65, 69-92 |
| IPR003629 | Granulocyte colony-stimulating/myelo-monocytic growth factor | BlastProDom | 81-104 |

Variant protein HUMGCSF_PEA_1_P6 is encoded by the following transcript(s): HUMGCSF_PEA_1_T5. The coding portion of transcript HUMGCSF_PEA_1_T5 starts at position 115 and ends at position 444. The transcript also has the following SNPs as listed in Table 367 (given according to their position on the nucleotide sequence, with the alternative nucleic acid listed; the last column indicates whether the SNP is known or not; the presence of known SNPs in variant protein HUMGCSF_PEA_1_P6 sequence provides support for the deduced sequence of this variant protein according to the present invention).

TABLE 367

Nucleic acid SNPs

| SNP position on nucleotide sequence | Alternative nucleic acid | Previously known SNP? |
| --- | --- | --- |
| 55 | C → G | Yes |
| 99 | A → G | Yes |
| 206 | C → | No |
| 292 | G → | No |
| 292 | G → C | No |
| 615 | G → | No |

TABLE 367-continued

Nucleic acid SNPs

| SNP position on nucleotide sequence | Alternative nucleic acid | Previously known SNP? |
| --- | --- | --- |
| 655 | G → T | No |
| 700 | A → G | No |
| 709 | T → C | No |
| 775 | G → A | Yes |
| 808 | C → G | Yes |
| 883 | T → C | No |
| 891 | C → A | Yes |
| 923 | G → | No |
| 942 | G → A | Yes |
| 977 | A → G | Yes |
| 1103 | G → A | No |
| 1187 | C → T | Yes |
| 1268 | A → G | Yes |
| 1319 | T → C | No |
| 1323 | C → | No |
| 1499 | C → | No |
| 1539 | C → | No |
| 1571 | C → T | Yes |
| 1626 | T → C | Yes |
| 1666 | G → A | Yes |
| 1736 | C → T | Yes |

Variant protein HUMGCSF_PEA_1_P7 (SEQ ID NO:1002) according to the present invention is encoded by transcript(s) HUMGCSF_PEA_1_T6. An alignment is given to the known protein (Granulocyte colony-stimulating factor precursor) in FIG. 239. One or more alignments to one or more previously published protein sequences are given in FIGS. 237-251. A brief description of the relationship of the variant protein according to the present invention to each such aligned protein is as follows:

Comparison Report Between HUMGCSF_PEA_1_P7 and CSF3_HUMAN:

1. An isolated chimeric polypeptide HUMGCSF_PEA_1_P7, comprising a first amino acid sequence being at least 90% homologous to MAGPATQSPMKLMALQLLLWH-SALWTVQEATPLGPASSLPQSFLLKCLEQV RKIQGD-GAALQEKLVSECATYKLCHPEELVLLGH-SLGIPWAPLSSCPSQALQL AGCLSQLHSGLFLYQGLLQALEGISPEL-GPTLDTLQLDVADFATTIWQQ corresponding to amino acids 1-153 of CSF3_HUMAN, which also corresponds to amino acids 1-153 of HUMGCSF_PEA_1_P7, and a second amino acid sequence being at least 70%, optionally at least 80%, preferably at least 85%, more preferably at least 90% and most preferably at least 95% homologous to a polypeptide having the sequence VSLVGQGGQGRAGILGTTAG-PVYGPCPCCQPPAFPHL corresponding to amino acids 154-190 of HUMGCSF_PEA_1_P7, wherein said first amino acid sequence and second amino acid sequence are contiguous and in a sequential order.

2. An isolated polypeptide for a tail of HUMGCSF_PEA_1_P7, comprising a polypeptide being at least 70%, optionally at least about 80%, preferably at least about 85%, more preferably at least about 90% and most preferably at least about 95% homologous to the sequence VSLVGQG-GQGRAGILGTTAGPVYGPCPCCQPPAFPHL in HUMGCSF_PEA_1_P7.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGCSF_PEA_1_P7 also has the following non-silent SNPs (Single Nucleotide Polymorphisms) as listed in Table 368, (given according to their position(s) on the amino acid sequence, with the alternative amino acid(s) listed; the last column indicates whether the SNP is known or not; the presence of known SNPs in variant protein HUMGCSF_PEA_1_P7 sequence provides support for the deduced sequence of this variant protein according to the present invention).

TABLE 368

Amino acid mutations

| SNP position(s) on amino acid sequence | Alternative amino acid(s) | Previously known SNP? |
|---|---|---|
| 31 | T → | No |
| 60 | A → | No |
| 60 | A → P | No |
| 119 | Q → | No |
| 133 | G → C | No |
| 148 | T → A | No |
| 151 | W → R | No |
| 173 | G → R | Yes |
| 184 | P → A | Yes |

The glycosylation sites of variant protein HUMGCSF_PEA_1_P7, as compared to the known protein Granulocyte colony-stimulating factor precursor, are described in Table 369 (given according to their position(s) on the amino acid sequence in the first column; the second column indicates whether the glycosylation site is present in the variant protein; and the last column indicates whether the position is different on the variant protein).

TABLE 369

Glycosylation site(s)

| Position(s) on known amino acid sequence | Present in variant protein? | Position in variant protein? |
|---|---|---|
| 166 | no | |

The variant protein has the following domains, as determined by using InterPro. The domains are described in Table 370:

TABLE 370

InterPro domain(s)

| InterPro ID | Domain description | Analysis type | Position(s) on protein |
|---|---|---|---|
| IPR003573 | Interleukin-6/G-CSF/MGF | FPrintScan | 50-65, 69-92, 97-122 |
| IPR003573 | Interleukin-6/G-CSF/MGF | HMMPfam | 51-176 |
| IPR003573 | Interleukin-6/G-CSF/MGF | HMMSmart | 51-176 |
| IPR003573 | Interleukin-6/G-CSF/MGF | ScanRegExp | 97-122 |
| IPR003629 | Granulocyte colony-stimulating/myelo-monocytic growth factor | BlastProDom | 81-151 |

Variant protein HUMGCSF_PEA_1_P7 is encoded by the following transcript(s): HUMGCSF_PEA_1_T6. The coding portion of transcript HUMGCSF_PEA_1_T6 starts at position 115 and ends at position 684. The transcript also has the following SNPs as listed in Table 371 (given according to their position on the nucleotide sequence, with the alternative nucleic acid listed; the last column indicates whether the SNP is known or not; the presence of known SNPs in variant protein HUMGCSF_PEA_1_P7 sequence provides support for the deduced sequence of this variant protein according to the present invention).

TABLE 371

Nucleic acid SNPs

| SNP position on nucleotide sequence | Alternative nucleic acid | Previously known SNP? |
|---|---|---|
| 55 | C → G | Yes |
| 99 | A → G | Yes |
| 206 | C → | No |
| 292 | G → | No |
| 292 | G → C | No |
| 471 | G → | No |
| 511 | G → T | No |
| 556 | A → G | No |
| 565 | T → C | No |
| 631 | G → A | Yes |
| 664 | C → G | Yes |
| 739 | T → C | No |
| 747 | C → A | Yes |
| 779 | G → | No |
| 798 | G → A | Yes |
| 833 | A → G | Yes |
| 959 | G → A | No |
| 1043 | C → T | Yes |
| 1124 | A → G | Yes |
| 1175 | T → C | No |
| 1179 | C → | No |
| 1355 | C → | No |
| 1395 | C → | No |
| 1427 | C → T | Yes |
| 1482 | T → C | Yes |
| 1522 | G → A | Yes |
| 1592 | C → T | Yes |

Variant protein HUMGCSF_PEA_1_P8 (SEQ ID NO:1003) according to the present invention is encoded by transcript(s) HUMGCSF_PEA_1_T7. An alignment is given to the known protein (Granulocyte colony-stimulating factor precursor) in FIG. 240. One or more alignments to one or more previously published protein sequences are given in FIGS. 237-251. A brief description of the relationship of the variant protein according to the present invention to each such aligned protein is as follows:

Comparison Report Between HUMGCSF_PEA_1_P8 and CSF3_HUMAN:

1. An isolated chimeric polypeptide HUMGCSF_PEA_1_P8, comprising a first amino acid sequence being at least 70%, optionally at least 80%, preferably at least 85%, more preferably at least 90% and most preferably at least 95% homologous to a polypeptide having the sequence MSPEPALSP corresponding to amino acids 1-9 of HUMGCSF_PEA_1_P8, a second amino acid sequence being at least 90% homologous to ALQLLLWHSALWTVQEATPLGPASSLPQSFLLKCLEQVRKIQGDGAALQEK corresponding to amino acids 14-64 of CSF3_HUMAN, which also corresponds to amino acids 10-60 of HUMGCSF_PEA_1_P8, a third amino acid sequence being at least 90% homologous to LAGCLSQLHSGLFLYQGLLQA-LEGISPELGPTLDTLQLDVADFATTIWQQ corresponding to amino acids 104-153 of CSF3_HUMAN, which also corresponds to amino acids 61-110 of HUMGCSF_PEA_1_P8, and a fourth amino acid sequence being at least 70%, optionally at least 80%, preferably at least 85%, more preferably at least 90% and most preferably at least 95% homologous to a polypeptide having the sequence VSLVGQGGQGRAGILGTTAGPVYGPCPCCQPPAFPHL corresponding to amino acids 111-147 of HUMGCSF_PEA_1_P8, wherein said first amino acid sequence, second amino acid sequence, third amino acid sequence and fourth amino acid sequence are contiguous and in a sequential order.

2. An isolated polypeptide for a head of HUMGCSF_PEA_1_P8, comprising a polypeptide being at least 70%, optionally at least about 80%, preferably at least about 85%, more preferably at least about 90% and most preferably at least about 95% homologous to the sequence MSPEPALSP of HUMGCSF_PEA_1_P8.

3. An isolated chimeric polypeptide for an edge portion of HUMGCSF_PEA_1_P8, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KL, having a structure as follows: a sequence starting from any of amino acid numbers 60-x to 60; and ending at any of amino acid numbers 61+((n−2)−x), in which x varies from 0 to n−2.

4. An isolated polypeptide for a tail of HUMGCSF_PEA_1_P8, comprising a polypeptide being at least 70%, optionally at least about 80%, preferably at least about 85%, more preferably at least about 90% and most preferably at least about 95% homologous to the sequence VSLVGQG-GQGRAGILGTTAGPVYGPCPCCQPPAFPHL in HUMGCSF_PEA_1_P8.

Comparison Report Between HUMGCSF_PEA_1_P8 and Q8N4W3:

1. An isolated chimeric polypeptide HUMGCSF_PEA_1_P8, comprising a first amino acid sequence being at least 90% homologous to MSPEPALSPALQLLLWHSAL-WTVQEATPLGPASSLPQSFLLKCLEQVRKIQGD GAALQEK corresponding to amino acids 1-60 of Q8N4W3, which also corresponds to amino acids 1-60 of HUMGCSF_PEA_1_P8, a second amino acid sequence being at least 90% homologous to LAGCLSQLHSGLFLYQGLLQA-LEGISPELGPTLDTLQLDVADFATTIWQQ corresponding to amino acids 97-146 of Q8N4W3, which also corresponds to amino acids 61-110 of HUMGCSF_PEA_1_P8, and a third amino acid sequence being at least 70%, optionally at least 80%, preferably at least 85%, more preferably at least 90% and most preferably at least 95% homologous to a polypeptide having the sequence VSLVGQG-GQGRAGILGTTAGPVYGPCPCCQPPAFPHL corresponding to amino acids 111-147 of HUMGCSF_PEA_1_P8, wherein said first amino acid sequence, second amino acid sequence and third amino acid sequence are contiguous and in a sequential order.

2. An isolated chimeric polypeptide for an edge portion of HUMGCSF_PEA_1_P8, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KL, having a structure as follows: a sequence starting from any of amino acid numbers 60-x to 60; and ending at any of amino acid numbers 61+((n−2)−x), in which x varies from 0 to n−2.

3. An isolated polypeptide for a tail of HUMGCSF_PEA_1_P8, comprising a polypeptide being at least 70%, optionally at least about 80%, preferably at least about 85%, more preferably at least about 90% and most preferably at least about 95% homologous to the sequence VSLVGQG-GQGRAGILGTTAGPVYGPCPCCQPPAFPHL in HUMGCSF_PEA_1_P8.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGCSF_PEA_1_P8 also has the following non-silent SNPs (Single Nucleotide Polymorphisms) as listed in Table 372, (given according to their position(s) on the amino acid sequence, with the alternative amino acid(s) listed; the last column indicates whether the SNP is known or not; the presence of known SNPs in variant protein HUMGCSF_PEA_1_P8 sequence provides support for the deduced sequence of this variant protein according to the present invention).

TABLE 372

Amino acid mutations

| SNP position(s) on amino acid sequence | Alternative amino acid(s) | Previously known SNP? |
|---|---|---|
| 27 | T → | No |
| 56 | A → P | No |
| 56 | A → | No |
| 76 | Q → | No |
| 90 | G → C | No |
| 105 | T → A | No |
| 108 | W → R | No |
| 130 | G → R | Yes |
| 141 | P → A | Yes |

The glycosylation sites of variant protein HUMGCSF_PEA_1_P8, as compared to the known protein Granulocyte colony-stimulating factor precursor, are described in Table 373 (given according to their position(s) on the amino acid sequence in the first column; the second column indicates whether the glycosylation site is present in the variant protein; and the last column indicates whether the position is different on the variant protein).

TABLE 373

Glycosylation site(s)

| Position(s) on known amino acid sequence | Present in variant protein? | Position in variant protein? |
|---|---|---|
| 166 | no | |

The variant protein has the following domains, as determined by using InterPro. The domains are described in Table 374:

TABLE 374

InterPro domain(s)

| InterPro ID | Domain description | Analysis type | Position(s) on protein |
| --- | --- | --- | --- |
| IPR003573 | Interleukin-6/G-CSF/MGF | HMMSmart | 47-133 |
| IPR003629 | Granulocyte colony-stimulating/myelo-monocytic growth factor | BlastProDom | 29-108 |

Variant protein HUMGCSF_PEA_1_P8 is encoded by the following transcript(s): HUMGCSF_PEA_1_T7. The coding portion of transcript HUMGCSF_PEA_1_T7 starts at position 303 and ends at position 743. The transcript also has the following SNPs as listed in Table 375 (given according to their position on the nucleotide sequence, with the alternative nucleic acid listed; the last column indicates whether the SNP is known or not; the presence of known SNPs in variant protein HUMGCSF_PEA_1_P8 sequence provides support for the deduced sequence of this variant protein according to the present invention).

TABLE 375

Nucleic acid SNPs

| SNP position on nucleotide sequence | Alternative nucleic acid | Previously known SNP? |
| --- | --- | --- |
| 55 | C → G | Yes |
| 99 | A → G | Yes |
| 382 | C → | No |
| 468 | G → | No |
| 468 | G → C | No |
| 530 | G → | No |
| 570 | G → T | No |
| 615 | A → G | No |
| 624 | T → C | No |
| 690 | G → A | Yes |
| 723 | C → G | Yes |
| 798 | T → C | No |
| 806 | C → A | Yes |
| 838 | G → | No |
| 857 | G → A | Yes |
| 892 | A → G | Yes |
| 1018 | G → A | No |
| 1102 | C → T | Yes |
| 1183 | A → G | Yes |
| 1234 | T → C | No |
| 1238 | C → | No |
| 1414 | C → | No |
| 1454 | C → | No |
| 1486 | C → T | Yes |
| 1541 | T → C | Yes |
| 1581 | G → A | Yes |
| 1651 | C → T | Yes |

Variant protein HUMGCSF_PEA_1_P9 (SEQ ID NO:1004) according to the present invention is encoded by transcript(s) HUMGCSF_PEA_1_T8 and HUMGCSF_PEA_1_T21. An alignment is given to the known protein (Granulocyte colony-stimulating factor precursor) in FIG. 242. One or more alignments to one or more previously published protein sequences are given in FIGS. 237-251. A brief description of the relationship of the variant protein according to the present invention to each such aligned protein is as follows:

Comparison Report Between HUMGCSF_PEA_1_P9 and CSF3_HUMAN:

1. An isolated chimeric polypeptide HUMGCSF_PEA_1_P9, comprising a first amino acid sequence being at least 90% homologous to MAGPATQSPMKLMALQLLLWH-SALWTVQEATPLGPASSLPQSFLLKCLEQV RKIQGD-GAALQEK corresponding to amino acids 1-64 of CSF3_HUMAN, which also corresponds to amino acids 1-64 of HUMGCSF_PEA_1_P9, and a second amino acid sequence being at least 90% homologous to LAGCLSQLH-SGLFLYQGLLQALEGISPEL-GPTLDTLQLDVADFATTIWQQMEE LGMAPALQPTQ-GAMPAFASAFQRRAGGVLVASHLQSFLEVSYRVLRH-LAQP corresponding to amino acids 104-207 of CSF3_HUMAN, which also corresponds to amino acids 65-168 of HUMGCSF_PEA_1_P9, wherein said first amino acid sequence and second amino acid sequence are contiguous and in a sequential order.

2. An isolated chimeric polypeptide for an edge portion of HUMGCSF_PEA_1_P9, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KL, having a structure as follows: a sequence starting from any of amino acid numbers 64-x to 64; and ending at any of amino acid numbers 65+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGCSF_PEA_1_P9 also has the following non-silent SNPs (Single Nucleotide Polymorphisms) as listed in Table 376, (given according to their position(s) on the amino acid sequence, with the alternative amino acid(s) listed; the last column indicates whether the SNP is known or not; the presence of known SNPs in variant protein HUMGCSF_PEA_1_P9 sequence provides support for the deduced sequence of this variant protein according to the present invention).

TABLE 376

Amino acid mutations

| SNP position(s) on amino acid sequence | Alternative amino acid(s) | Previously known SNP? |
| --- | --- | --- |
| 31 | T → | No |
| 60 | A → P | No |
| 60 | A → | No |
| 80 | Q → | No |
| 94 | G → C | No |
| 109 | T → A | No |
| 112 | W → R | No |
| 115 | M → T | No |
| 118 | L → M | Yes |
| 128 | Q → | No |
| 135 | A → T | Yes |

The glycosylation sites of variant protein HUMGCSF_PEA_1_P9, as compared to the known protein Granulocyte colony-stimulating factor precursor, are described in Table 377 (given according to their position(s) on the amino acid sequence in the first column; the second column indicates whether the glycosylation site is present in the variant protein; and the last column indicates whether the position is different on the variant protein).

TABLE 377

| Glycosylation site(s) | | |
|---|---|---|
| Position(s) on known amino acid sequence | Present in variant protein? | Position in variant protein? |
| 166 | yes | 127 |

The variant protein has the following domains, as determined by using InterPro. The domains are described in Table 378

TABLE 378

| InterPro domain(s) | | | |
|---|---|---|---|
| InterPro ID | Domain description | Analysis type | Position(s) on protein |
| IPR003573 | Interleukin-6/G-CSF/MGF | FPrintScan | 147-163, 58-83 |
| IPR003573 | Interleukin-6/G-CSF/MGF | HMMPfam | 51-163 |
| IPR003573 | Interleukin-6/G-CSF/MGF | HMMSmart | 51-163 |
| IPR003629 | Granulocyte colony-stimulating/myelo-monocytic growth factor | BlastProDom | 33-168 |
| IPR003573 | Interleukin-6/G-CSF/MGF | FPrintScan | 147-163, 58-83 |
| IPR003573 | Interleukin-6/G-CSF/MGF | HMMPfam | 51-163 |
| IPR003573 | Interleukin-6/G-CSF/MGF | HMMSmart | 51-163 |
| IPR003629 | Granulocyte colony-stimulating/myelo-monocytic growth factor | BlastProDom | 33-168 |
| IPR003573 | Interleukin-6/G-CSF/MGF | FPrintScan | 147-163, 58-83 |
| IPR003573 | Interleukin-6/G-CSF/MGF | HMMPfam | 51-163 |
| IPR003573 | Interleukin-6/G-CSF/MGF | HMMSmart | 51-163 |
| IPR003629 | Granulocyte colony-stimulating/myelo-monocytic growth factor | BlastProDom | 33-168 |
| IPR003573 | Interleukin-6/G-CSF/MGF | FPrintScan | 147-163, 58-83 |
| IPR003573 | Interleukin-6/G-CSF/MGF | HMMPfam | 51-163 |
| IPR003573 | Interleukin-6/G-CSF/MGF | HMMSmart | 51-163 |
| IPR003629 | Granulocyte colony-stimulating/myelo-monocytic growth factor | BlastProDom | 33-168 |

Variant protein HUMGCSF_PEA_1_P9 is encoded by the following transcript(s): HUMGCSF_PEA_1_T8 and HUMGCSF_PEA_1_T21.

The coding portion of transcript HUMGCSF_PEA_1_T8 starts at position 115 and ends at position 618. The transcript also has the following SNPs as listed in Table 379 (given according to their position on the nucleotide sequence, with the alternative nucleic acid listed; the last column indicates whether the SNP is known or not; the presence of known SNPs in variant protein HUMGCSF_PEA_1_P9 sequence provides support for the deduced sequence of this variant protein according to the present invention).

TABLE 379

| Nucleic acid SNPs | | |
|---|---|---|
| SNP position on nucleotide sequence | Alternative nucleic acid | Previously known SNP? |
| 55 | C → G | Yes |
| 99 | A → G | Yes |
| 206 | C → | No |
| 292 | G → | No |
| 292 | G → C | No |
| 354 | G → | No |
| 394 | G → T | No |
| 439 | A → G | No |
| 448 | T → C | No |
| 458 | T → C | No |
| 466 | C → A | Yes |
| 498 | G → | No |
| 517 | G → A | Yes |
| 552 | A → G | Yes |
| 678 | G → A | No |
| 762 | C → T | Yes |
| 843 | A → G | Yes |
| 894 | T → C | No |
| 898 | C → | No |
| 1074 | C → | No |
| 1114 | C → | No |
| 1146 | C → T | Yes |
| 1201 | T → C | Yes |
| 1241 | G → A | Yes |
| 1311 | C → T | Yes |

The coding portion of transcript HUMGCSF_PEA_1_T21 starts at position 115 and ends at position 618. The transcript also has the following SNPs as listed in Table 380 (given according to their position on the nucleotide sequence, with the alternative nucleic acid listed; the last column indicates whether the SNP is known or not; the presence of known SNPs in variant protein HUMGCSF_PEA_1_P9 sequence provides support for the deduced sequence of this variant protein according to the present invention).

TABLE 380

| Nucleic acid SNPs | | |
|---|---|---|
| SNP position on nucleotide sequence | Alternative nucleic acid | Previously known SNP? |
| 55 | C → G | Yes |
| 99 | A → G | Yes |
| 206 | C → | No |
| 292 | G → | No |
| 292 | G → C | No |
| 354 | G → | No |
| 394 | G → T | No |
| 439 | A → G | No |
| 448 | T → C | No |
| 458 | T → C | No |
| 466 | C → A | Yes |
| 498 | G → | No |
| 517 | G → A | Yes |
| 552 | A → G | Yes |
| 678 | G → A | No |
| 762 | C → T | Yes |
| 843 | A → G | Yes |
| 894 | T → C | No |
| 898 | C → | No |
| 1074 | C → | No |
| 1114 | C → | No |
| 1146 | C → T | Yes |
| 1201 | T → C | Yes |
| 1241 | G → A | Yes |
| 1311 | C → T | Yes |

Variant protein HUMGCSF_PEA_1_P13 (SEQ ID NO:1005) according to the present invention is encoded by transcript(s) HUMGCSF_PEA_1_T13 and HUMGCSF_PEA_1_T20. An alignment is given to the known protein (Granulocyte colony-stimulating factor precursor) in FIG. 243. One or more alignments to one or more previously published protein sequences are given in FIGS. 237-251. A brief description of the relationship of the variant protein according to the present invention to each such aligned protein is as follows:

Comparison Report Between HUMGCSF_PEA_1_P13 and CSF3_HUMAN:

1. An isolated chimeric polypeptide HUMGCSF_PEA_1_P13, comprising a first amino acid sequence being at least 90% homologous to MAGPATQSPMKLMALQLLLWH-SALWTVQEATPLGPASSLPQSFLLKCLEQV RKIQGD-GAALQEKLVSE corresponding to amino acids 1-68 of CSF3_HUMAN, which also corresponds to amino acids 1-68 of HUMGCSF_PEA_1_P13, and a second amino acid sequence being at least 90% homologous to AGCLSQLHS-GLFLYQGLLQALEGISPEL-GPTLDTLQLDVADFATTIWQQMEEL GMAPALQPTQ-GAMPAFASAFQRRAGGVLVASHLQSFLEVSYRVLRH-LAQP corresponding to amino acids 105-207 of CSF3_HUMAN, which also corresponds to amino acids 69-171 of HUMGCSF_PEA_1_P13, wherein said first amino acid sequence and second amino acid sequence are contiguous and in a sequential order.

2. An isolated chimeric polypeptide for an edge portion of HUMGCSF_PEA_1_P13, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EA, having a structure as follows: a sequence starting from any of amino acid numbers 68-x to 68; and ending at any of amino acid numbers 69+((n–2)–x), in which x varies from 0 to n–2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGCSF_PEA_1_P13 also has the following non-silent SNPs (Single Nucleotide Polymorphisms) as listed in Table 381, (given according to their position(s) on the amino acid sequence, with the alternative amino acid(s) listed; the last column indicates whether the SNP is known or not; the presence of known SNPs in variant protein HUMGCSF_PEA_1_P13 sequence provides support for the deduced sequence of this variant protein according to the present invention).

TABLE 381

Amino acid mutations

| SNP position(s) on amino acid sequence | Alternative amino acid(s) | Previously known SNP? |
|---|---|---|
| 31 | T → | No |
| 60 | A → P | No |
| 60 | A → | No |
| 83 | Q → | No |
| 97 | G → C | No |
| 112 | T → A | No |
| 115 | W → R | No |
| 118 | M → T | No |
| 121 | L → M | Yes |
| 131 | Q → | No |
| 138 | A → T | Yes |

The glycosylation sites of variant protein HUMGCSF_PEA_1_P13, as compared to the known protein Granulocyte colony-stimulating factor precursor, are described in Table 382 (given according to their position(s) on the amino acid sequence in the first column; the second column indicates whether the glycosylation site is present in the variant protein; and the last column indicates whether the position is different on the variant protein).

TABLE 382

Glycosylation site(s)

| Position(s) on known amino acid sequence | Present in variant protein? | Position in variant protein? |
|---|---|---|
| 166 | yes | 130 |

The variant protein has the following domains, as determined by using InterPro. The domains are described in Table 383:

TABLE 383

InterPro domain(s)

| InterPro ID | Domain description | Analysis type | Position(s) on protein |
|---|---|---|---|
| IPR003573 | Interleukin-6/G-CSF/MGF | FPrintScan | 150-166, 61-86 |
| IPR003573 | Interleukin-6/G-CSF/MGF | HMMPfam | 51-166 |
| IPR003573 | Interleukin-6/G-CSF/MGF | HMMSmart | 51-166 |
| IPR003629 | Granulocyte colony-stimulating/myelo-monocytic growth factor | BlastProDom | 69-171 |
| IPR003573 | Interleukin-6/G-CSF/MGF | FPrintScan | 150-166, 61-86 |
| IPR003573 | Interleukin-6/G-CSF/MGF | HMMPfam | 51-166 |
| IPR003573 | Interleukin-6/G-CSF/MGF | HMMSmart | 51-166 |
| IPR003629 | Granulocyte colony-stimulating/myelo-monocytic growth factor | BlastProDom | 69-171 |
| IPR003573 | Interleukin-6/G-CSF/MGF | FPrintScan | 150-166, 61-86 |
| IPR003573 | Interleukin-6/G-CSF/MGF | HMMPfam | 51-166 |
| IPR003573 | Interleukin-6/G-CSF/MGF | HMMSmart | 51-166 |
| IPR003629 | Granulocyte colony-stimulating/myelo-monocytic growth factor | BlastProDom | 69-171 |
| IPR003573 | Interleukin-6/G-CSF/MGF | FPrintScan | 150-166, 61-86 |

TABLE 383-continued

InterPro domain(s)

| InterPro ID | Domain description | Analysis type | Position(s) on protein |
|---|---|---|---|
| IPR003573 | Interleukin-6/G-CSF/MGF | HMMPfam | 51-166 |
| IPR003573 | Interleukin-6/G-CSF/MGF | HMMSmart | 51-166 |
| IPR003629 | Granulocyte colony-stimulating/myelo-monocytic growth factor | BlastProDom | 69-171 |

Variant protein HUMGCSF_PEA_1_P13 is encoded by the following transcript(s): HUMGCSF_PEA_1_T13 and HUMGCSF_PEA_1_T20.

The coding portion of transcript HUMGCSF_PEA_1_T13 starts at position 115 and ends at position 627. The transcript also has the following SNPs as listed in Table 384 (given according to their position on the nucleotide sequence, with the alternative nucleic acid listed; the last column indicates whether the SNP is known or not; the presence of known SNPs in variant protein HUMGCSF_PEA_1_P13 sequence provides support for the deduced sequence of this variant protein according to the present invention).

TABLE 384

Nucleic acid SNPs

| SNP position on nucleotide sequence | Alternative nucleic acid | Previously known SNP? |
|---|---|---|
| 55 | C → G | Yes |
| 99 | A → G | Yes |
| 206 | C → | No |
| 292 | G → | No |
| 292 | G → C | No |
| 363 | G → | No |
| 403 | G → T | No |
| 448 | A → G | No |
| 457 | T → C | No |
| 467 | T → C | No |
| 475 | C → A | Yes |
| 507 | G → | No |
| 526 | G → A | Yes |
| 561 | A → G | Yes |
| 687 | G → A | No |
| 771 | C → T | Yes |
| 852 | A → G | Yes |
| 903 | T → C | No |
| 907 | C → | No |
| 1083 | C → | No |
| 1123 | C → | No |
| 1155 | C → T | Yes |
| 1210 | T → C | Yes |
| 1250 | G → A | Yes |
| 1320 | C → T | Yes |

The coding portion of transcript HUMGCSF_PEA_1_T20 starts at position 115 and ends at position 627. The transcript also has the following SNPs as listed in Table 385 (given according to their position on the nucleotide sequence, with the alternative nucleic acid listed; the last column indicates whether the SNP is known or not; the presence of known SNPs in variant protein HUMGCSF_PEA_1_P13 sequence provides support for the deduced sequence of this variant protein according to the present invention).

TABLE 385

Nucleic acid SNPs -

| SNP position on nucleotide sequence | Alternative nucleic acid | Previously known SNP? |
|---|---|---|
| 55 | C → G | Yes |
| 99 | A → G | Yes |
| 206 | C → | No |
| 292 | G → | No |
| 292 | G → C | No |
| 363 | G → | No |
| 403 | G → T | No |
| 448 | A → G | No |
| 457 | T → C | No |
| 467 | T → C | No |
| 475 | C → A | Yes |
| 507 | G → | No |
| 526 | G → A | Yes |
| 561 | A → G | Yes |
| 687 | G → A | No |
| 771 | C → T | Yes |
| 852 | A → G | Yes |
| 903 | T → C | No |
| 907 | C → | No |
| 1083 | C → | No |
| 1123 | C → | No |
| 1155 | C → T | Yes |
| 1210 | T → C | Yes |
| 1250 | G → A | Yes |
| 1320 | C → T | Yes |

Variant protein HUMGCSF_PEA_1_P14 (SEQ ID NO:1006) according to the present invention is encoded by transcript(s) HUMGCSF_PEA_1_T14. An alignment is given to the known protein (Granulocyte colony-stimulating factor precursor) in FIG. 244. One or more alignments to one or more previously published protein sequences are given in FIGS. 237-251. A brief description of the relationship of the variant protein according to the present invention to each such aligned protein is as follows:

Comparison Report Between HUMGCSF_PEA_1_P14 and CSF3_HUMAN:

1. An isolated chimeric polypeptide HUMGCSF_PEA_1_P14, comprising a first amino acid sequence being at least 70%, optionally at least 80%, preferably at least 85%, more preferably at least 90% and most preferably at least 95% homologous to a polypeptide having the sequence MSPEPALSP corresponding to amino acids 1-9 of HUMGCSF_PEA_1_P14, a second amino acid sequence being at least 90% homologous to ALQLLLWHSALWTVQEATPLG-PASSLPQSFLLKCLEQVRKIQGDGAALQEKL corresponding to amino acids 14-65 of CSF3_HUMAN, which also corresponds to amino acids 10-61 of HUMGCSF_PEA_1_P14, a third amino acid sequence being at least 90% homologous to CATYKLCHPEELVLLGHSLGIPWAPLSS-CPSQALQL corresponding to amino acids 69-104 of CSF3_HUMAN, which also corresponds to amino acids 62-97 of HUMGCSF_PEA_1_P14, and a fourth amino acid sequence being at least 70%, optionally at least 80%, preferably at least 85%, more preferably at least 90% and most preferably at least 95% homologous to a polypeptide having the sequence VSVRKG corresponding to amino acids 98-103 of HUMGCSF_PEA_1_P14, wherein said first amino acid sequence, second amino acid sequence, third amino acid sequence and fourth amino acid sequence are contiguous and in a sequential order.

2. An isolated polypeptide for a head of HUMGCSF_PEA_1_P14, comprising a polypeptide being at least 70%, optionally at least about 80%, preferably at least about 85%, more preferably at least about 90% and most preferably at least about 95% homologous to the sequence MSPEPALSP of HUMGCSF_PEA_1_P14.

3. An isolated chimeric polypeptide for an edge portion of HUMGCSF_PEA_1_P14, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LC, having a structure as follows: a sequence starting from any of amino acid numbers 61-x to 61; and ending at any of amino acid numbers 62+((n−2)−x), in which x varies from 0 to n−2.

4. An isolated polypeptide for a tail of HUMGCSF_PEA_1_P14, comprising a polypeptide being at least 70%, optionally at least about 80%, preferably at least about 85%, more preferably at least about 90% and most preferably at least about 95% homologous to the sequence VSVRKG in HUMGCSF_PEA_1_P14.

Comparison Report Between HUMGCSF_PEA_1_P14 and Q8N4W3:

1. An isolated chimeric polypeptide HUMGCSF_PEA_1_P14, comprising a first amino acid sequence being at least 90% homologous to MSPEPALSPALQLLLWHSAL-WTVQEATPLGPASSLPQSFLLKCLEQVRKIQGD GAALQEKLCATYKLCHPEELVLLGHSL-GIPWAPLSSCPSQALQL corresponding to amino acids 1-97 of Q8N4W3, which also corresponds to amino acids 1-97 of HUMGCSF_PEA_1_P14, and a second amino acid sequence being at least 70%, optionally at least 80%, preferably at least 85%, more preferably at least 90% and most preferably at least 95% homologous to a polypeptide having the sequence VSVRKG corresponding to amino acids 98-103 of HUMGCSF_PEA_1_P14, wherein said first amino acid sequence and second amino acid sequence are contiguous and in a sequential order.

2. An isolated polypeptide for a tail of HUMGCSF_PEA_1_P14, comprising a polypeptide being at least 70%, optionally at least about 80%, preferably at least about 85%, more preferably at least about 90% and most preferably at least about 95% homologous to the sequence VSVRKG in HUMGCSF_PEA_1_P14.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGCSF_PEA_1_P14 also has the following non-silent SNPs (Single Nucleotide Polymorphisms) as listed in Table 386, (given according to their position(s) on the amino acid sequence, with the alternative amino acid(s) listed; the last column indicates whether the SNP is known or not; the presence of known SNPs in variant protein HUMGCSF_PEA_1_P14 sequence provides support for the deduced sequence of this variant protein according to the present invention).

TABLE 386

Amino acid mutations

| SNP position(s) on amino acid sequence | Alternative amino acid(s) | Previously known SNP? |
|---|---|---|
| 27 | T → | No |
| 56 | A → | No |
| 56 | A → P | No |

The glycosylation sites of variant protein HUMGCSF_PEA_1_P14, as compared to the known protein Granulocyte colony-stimulating factor precursor, are described in Table 387 (given according to their position(s) on the amino acid sequence in the first column; the second column indicates whether the glycosylation site is present in the variant protein; and the last column indicates whether the position is different on the variant protein).

TABLE 387

Glycosylation site(s)

| Position(s) on known amino acid sequence | Present in variant protein? | Position in variant protein? |
|---|---|---|
| 166 | no | |

The variant protein has the following domains, as determined by using InterPro. The domains are described in Table 388:

TABLE 388

InterPro domain(s)

| InterPro ID | Domain description | Analysis type | Position(s) on protein |
|---|---|---|---|
| IPR003573 | Interleukin-6/G-CSF/MGF | FPrintScan | 46-61, 62-85 |
| IPR003629 | Granulocyte colony-stimulating/myelo-monocytic growth factor | BlastProDom | 74-97 |

Variant protein HUMGCSF_PEA_1_P14 is encoded by the following transcript(s): HUMGCSF_PEA_1_T14. The coding portion of transcript HUMGCSF_PEA_1_T14 starts at position 303 and ends at position 611. The transcript also has the following SNPs as listed in Table 389 (given according to their position on the nucleotide sequence, with the alternative nucleic acid listed; the last column indicates whether the SNP is known or not; the presence of known SNPs in variant protein HUMGCSF_PEA_1_P14 sequence provides support for the deduced sequence of this variant protein according to the present invention).

TABLE 389

Nucleic acid SNPs

| SNP position on nucleotide sequence | Alternative nucleic acid | Previously known SNP? |
|---|---|---|
| 55 | C → G | Yes |
| 99 | A → G | Yes |
| 382 | C → | No |
| 468 | G → | No |
| 468 | G → C | No |
| 782 | G → | No |

TABLE 389-continued

Nucleic acid SNPs

| SNP position on nucleotide sequence | Alternative nucleic acid | Previously known SNP? |
|---|---|---|
| 822 | G → T | No |
| 867 | A → G | No |
| 876 | T → C | No |
| 886 | T → C | No |
| 894 | C → A | Yes |
| 926 | G → | No |
| 945 | G → A | Yes |
| 980 | A → G | Yes |
| 1106 | G → A | No |
| 1190 | C → T | Yes |
| 1271 | A → G | Yes |
| 1322 | T → C | No |
| 1326 | C → | No |
| 1502 | C → | No |
| 1542 | C → | No |
| 1574 | C → T | Yes |
| 1629 | T → C | Yes |
| 1669 | G → A | Yes |
| 1739 | C → T | Yes |

Variant protein HUMGCSF_PEA_1_P16 (SEQ ID NO:1007) according to the present invention is encoded by transcript(s) HUMGCSF_PEA_1_T16. An alignment is given to the known protein (Granulocyte colony-stimulating factor precursor) in FIG. 246. One or more alignments to one or more previously published protein sequences are given in FIGS. 237-251. A brief description of the relationship of the variant protein according to the present invention to each such aligned protein is as follows:

Comparison Report Between HUMGCSF_PEA_1_P16 and CSF3_HUMAN:

1. An isolated chimeric polypeptide HUMGCSF_PEA_1_P16, comprising a first amino acid sequence being at least 90% homologous to MAGPATQSPMKLMALQLLLWH-SALWTVQEATPLGPASSLPQSFLLKCLEQV RKIQGD-GAALQEKLVSE corresponding to amino acids 1-68 of CSF3_HUMAN, which also corresponds to amino acids 1-68 of HUMGCSF_PEA_1_P16, a second amino acid sequence being at least 90% homologous to AGCLSQLHSGLFLY-QGLLQALEGISPELGPTLDTLQLDVADFATTIWQQ corresponding to amino acids 105-153 of CSF3_HUMAN, which also corresponds to amino acids 69-117 of HUMGCSF_PEA_1_P16, and a third amino acid sequence being at least 70%, optionally at least 80%, preferably at least 85%, more preferably at least 90% and most preferably at least 95% homologous to a polypeptide having the sequence VSLVGQGGQGRAGILGTTAGPVYGPCPCCQPPAFPHL corresponding to amino acids 118-154 of HUMGCSF_PEA_1_P16, wherein said first amino acid sequence, second amino acid sequence and third amino acid sequence are contiguous and in a sequential order.

2. An isolated chimeric polypeptide for an edge portion of HUMGCSF_PEA_1_P16, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EA, having a structure as follows: a sequence starting from any of amino acid numbers 68-x to 68; and ending at any of amino acid numbers 69+((n−2)−x), in which x varies from 0 to n−2.

3. An isolated polypeptide for a tail of HUMGCSF_PEA_1_P16, comprising a polypeptide being at least 70%, optionally at least about 80%, preferably at least about 85%, more preferably at least about 90% and most preferably at least about 95% homologous to the sequence VSLVGQG-GQGRAGILGTTAGPVYGPCPCCQPPAFPHL in HUMGCSF_PEA_1_P16.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGCSF_PEA_1_P16 also has the following non-silent SNPs (Single Nucleotide Polymorphisms) as listed in Table 390, (given according to their position(s) on the amino acid sequence, with the alternative amino acid(s) listed; the last column indicates whether the SNP is known or not; the presence of known SNPs in variant protein HUMGCSF_PEA_1_P16 sequence provides support for the deduced sequence of this variant protein according to the present invention).

TABLE 390

Amino acid mutations

| SNP position(s) on amino acid sequence | Alternative amino acid(s) | Previously known SNP? |
|---|---|---|
| 31 | T → | No |
| 60 | A → P | No |
| 60 | A → | No |
| 83 | Q → | No |
| 97 | G → C | No |
| 112 | T → A | No |
| 115 | W → R | No |
| 137 | G → R | Yes |
| 148 | P → A | Yes |

The glycosylation sites of variant protein HUMGCSF_PEA_1_P16, as compared to the known protein Granulocyte colony-stimulating factor precursor, are described in Table 391 (given according to their position(s) on the amino acid sequence in the first column; the second column indicates whether the glycosylation site is present in the variant protein; and the last column indicates whether the position is different on the variant protein).

TABLE 391

Glycosylation site(s)

| Position(s) on known amino acid sequence | Present in variant protein? | Position in variant protein? |
|---|---|---|
| 166 | no | |

The variant protein has the following domains, as determined by using InterPro. The domains are described in Table 392:

TABLE 392

InterPro domain(s)

| InterPro ID | Domain description | Analysis type | Position(s) on protein |
|---|---|---|---|
| IPR003573 | Interleukin-6/G-CSF/MGF | HMMSmart | 51-140 |
| IPR003629 | Granulocyte colony-stimulating/myelo-monocytic growth factor | BlastProDom | 69-115 |

Variant protein HUMGCSF_PEA_1_P16 is encoded by the following transcript(s): HUMGCSF_PEA_1_T16. The coding portion of transcript HUMGCSF_PEA_1_T16 starts at position 115 and ends at position 576. The transcript also has the following SNPs as listed in Table 393 (given according to their position on the nucleotide sequence, with the alternative nucleic acid listed; the last column indicates whether the SNP is known or not; the presence of known SNPs in variant protein HUMGCSF_PEA_1_P16 sequence provides support for the deduced sequence of this variant protein according to the present invention).

TABLE 393

Nucleic acid SNPs

| SNP position on nucleotide sequence | Alternative nucleic acid | Previously known SNP? |
|---|---|---|
| 55 | C → G | Yes |
| 99 | A → G | Yes |
| 206 | C → | No |
| 292 | G → | No |
| 292 | G → C | No |
| 363 | G → | No |
| 403 | G → T | No |
| 448 | A → G | No |
| 457 | T → C | No |
| 523 | G → A | Yes |
| 556 | C → G | Yes |
| 631 | T → C | No |
| 639 | C → A | Yes |
| 671 | G → | No |
| 690 | G → A | Yes |
| 725 | A → G | Yes |
| 851 | G → A | No |
| 935 | C → T | Yes |
| 1016 | A → G | Yes |
| 1067 | T → C | No |
| 1071 | C → | No |
| 1247 | C → | No |
| 1287 | C → | No |
| 1319 | C → T | Yes |
| 1374 | T → C | Yes |
| 1414 | G → A | Yes |
| 1484 | C → T | Yes |

Variant protein HUMGCSF_PEA_1_P18 (SEQ ID NO:1008) according to the present invention is encoded by transcript(s) HUMGCSF_PEA_1_T18. An alignment is given to the known protein (Granulocyte colony-stimulating factor precursor; CSF3_HUMAN (SEQ ID NO:128) in FIG. 247. One or more alignments to one or more previously published protein sequences are given in FIGS. 237-251. A brief description of the relationship of the variant protein according to the present invention to each such aligned protein is as follows:

Comparison Report Between HUMGCSF_PEA_1_P18 and CSF3_HUMAN:

1. An isolated chimeric polypeptide HUMGCSF_PEA_1_P18, comprising a first amino acid sequence being at least 90% homologous to MAGPATQSPMKLMALQLLLWH-SALWTVQEATPLGPASSLPQSFLLKCLEQV RKIQGD-GAALQEKL corresponding to amino acids 1-65 of CSF3_HUMAN, which also corresponds to amino acids 1-65 of HUMGCSF_PEA_1_P18, a second amino acid sequence being at least 90% homologous to CATYKLCHPEELV-LLGHSLGIPWAPLSSCPSQALQLAG-CLSQLHSGLFLYQGL LQALEGISPELGPTLDTLQLD-VADFATTIWQQ corresponding to amino acids 69-153 of CSF3_HUMAN, which also corresponds to amino acids 66-150 of HUMGCSF_PEA_1_P18, and a third amino acid sequence being at least 70%, optionally at least 80%, preferably at least 85%, more preferably at least 90% and most preferably at least 95% homologous to a polypeptide having the sequence VSLVGQGGQGRAGILGTTAGPVYGPCPC-CQPPAFPHL corresponding to amino acids 151-187 of HUMGCSF_PEA_1_P18, wherein said first amino acid sequence, second amino acid sequence and third amino acid sequence are contiguous and in a sequential order.

2. An isolated chimeric polypeptide for an edge portion of HUMGCSF_PEA_1_P18, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LC, having a structure as follows: a sequence starting from any of amino acid numbers 65-x to 65; and ending at any of amino acid numbers 66+((n−2)−x), in which x varies from 0 to n−2.

3. An isolated polypeptide for a tail of HUMGCSF_PEA_1_P18, comprising a polypeptide being at least 70%, optionally at least about 80%, preferably at least about 85%, more preferably at least about 90% and most preferably at least about 95% homologous to the sequence VSLVGQG-GQGRAGILGTTAGPVYGPCPCCQPPAFPHL in HUMGCSF_PEA_1_P18.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGCSF_PEA_1_P18 also has the following non-silent SNPs (Single Nucleotide Polymorphisms) as listed in Table 394, (given according to their position(s) on the amino acid sequence, with the alternative amino acid(s) listed; the last column indicates whether the SNP is known or not; the presence of known SNPs in variant protein HUMGCSF_PEA_1_P18 sequence provides support for the deduced sequence of this variant protein according to the present invention).

TABLE 394

Amino acid mutations

| SNP position(s) on amino acid sequence | Alternative amino acid(s) | Previously known SNP? |
|---|---|---|
| 31 | T → | No |
| 60 | A → | No |
| 60 | A → P | No |
| 116 | Q → | No |

TABLE 394-continued

Amino acid mutations

| SNP position(s) on amino acid sequence | Alternative amino acid(s) | Previously known SNP? |
|---|---|---|
| 130 | G → C | No |
| 145 | T → A | No |
| 148 | W → R | No |
| 170 | G → R | Yes |
| 181 | P → A | Yes |

The glycosylation sites of variant protein HUMGCSF_PEA_1_P18, as compared to the known protein Granulocyte colony-stimulating factor precursor, are described in Table 395 (given according to their position(s) on the amino acid sequence in the first column; the second column indicates whether the glycosylation site is present in the variant protein; and the last column indicates whether the position is different on the variant protein).

TABLE 395

Glycosylation site(s)

| Position(s) on known amino acid sequence | Present in variant protein? | Position in variant protein? |
|---|---|---|
| 166 | no | |

The variant protein has the following domains, as determined by using InterPro. The domains are described in Table 396:

TABLE 396

InterPro domain(s)

| InterPro ID | Domain description | Analysis type | Position(s) on protein |
|---|---|---|---|
| IPR003573 | Interleukin-6/G-CSF/MGF | FPrintScan | 50-65, 66-89, 94-119 |
| IPR003573 | Interleukin-6/G-CSF/MGF | HMMPfam | 51-173 |
| IPR003573 | Interleukin-6/G-CSF/MGF | HMMSmart | 51-173 |
| IPR003573 | Interleukin-6/G-CSF/MGF | ScanRegExp | 94-119 |
| IPR003629 | Granulocyte colony-stimulating/myelomonocytic growth factor | BlastProDom | 78-148 |

Variant protein HUMGCSF_PEA_1_P18 is encoded by the following transcript(s): HUMGCSF_PEA_1_T18. The coding portion of transcript HUMGCSF_PEA_1_T18 starts at position 115 and ends at position 675. The transcript also has the following SNPs as listed in Table 397 (given according to their position on the nucleotide sequence, with the alternative nucleic acid listed; the last column indicates whether the SNP is known or not; the presence of known SNPs in variant protein HUMGCSF_PEA_1_P18 sequence provides support for the deduced sequence of this variant protein according to the present invention).

TABLE 397

Nucleic acid SNPs

| SNP position on nucleotide sequence | Alternative nucleic acid | Previously known SNP? |
|---|---|---|
| 55 | C → G | Yes |
| 99 | A → G | Yes |
| 206 | C → | No |
| 292 | G → | No |
| 292 | G → C | No |
| 462 | G → | No |
| 502 | G → T | No |
| 547 | A → G | No |
| 556 | T → C | No |
| 622 | G → A | Yes |
| 655 | C → G | Yes |
| 730 | T → C | No |
| 738 | C → A | Yes |
| 770 | G → | No |
| 789 | G → A | Yes |
| 824 | A → G | Yes |
| 950 | G → A | No |
| 1034 | C → T | Yes |
| 1115 | A → G | Yes |
| 1166 | T → C | No |
| 1170 | C → | No |
| 1346 | C → | No |
| 1386 | C → | No |
| 1418 | C → T | Yes |
| 1473 | T → C | Yes |
| 1513 | G → A | Yes |
| 1583 | C → T | Yes |

Variant protein HUMGCSF_PEA_1_P19 (SEQ ID NO:1009) according to the present invention is encoded by transcript(s) HUMGCSF_PEA_1_T19. An alignment is given to the known protein (Granulocyte colony-stimulating factor precursor) in FIG. 248. One or more alignments to one or more previously published protein sequences are given in FIGS. 237-251. A brief description of the relationship of the variant protein according to the present invention to each such aligned protein is as follows:

Comparison Report Between HUMGCSF_PEA_1_P19 and CSF3_HUMAN:

1. An isolated chimeric polypeptide HUMGCSF_PEA_1_P19, comprising a first amino acid sequence being at least 70%, optionally at least 80%, preferably at least 85%, more preferably at least 90% and most preferably at least 95% homologous to a polypeptide having the sequence MSPEPALSP corresponding to amino acids 1-9 of HUMGCSF_PEA_1_P19, a second amino acid sequence being at least 90% homologous to ALQLLLWHSALWTVQEATPLGPASSLPQSFLLKCLEQVRKIQGDGAALQEKL VSE corresponding to amino acids 14-68 of CSF3_HUMAN, which also corresponds to amino acids 10-64 of HUMGCSF_PEA_1_P19, a third amino acid sequence being at least 90% homologous to AGCLSQLHSGLFLYQGLLQALEGISPEL-GPTLDTLQLDVADFATTIWQQ corresponding to amino acids 105-153 of CSF3_HUMAN, which also corresponds to amino acids 65-113 of HUMGCSF_PEA_1_P19, and a fourth amino acid sequence being at least 70%, optionally at least 80%, preferably at least 85%, more preferably at least 90% and most preferably at least 95% homologous to a polypeptide having the sequence VSLVGQG-GQGRAGILGTTAGPVYGPCPCCQPPAFPHL corresponding to amino acids 114-150 of HUMGCSF_PEA_1_P19, wherein said first amino acid sequence, second amino acid sequence, third amino acid sequence and fourth amino acid sequence are contiguous and in a sequential order.

2. An isolated polypeptide for a head of HUMGCSF_PEA_1_P19, comprising a polypeptide being at least 70%, optionally at least about 80%, preferably at least about 85%, more preferably at least about 90% and most preferably at least about 95% homologous to the sequence MSPEPALSP of HUMGCSF_PEA_1_P19.

3. An isolated chimeric polypeptide for an edge portion of HUMGCSF_PEA_1_P19, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EA, having a structure as follows: a sequence starting from any of amino acid numbers 64-x to 64; and ending at any of amino acid numbers 65+((n−2)−x), in which x varies from 0 to n−2.

4. An isolated polypeptide for a tail of HUMGCSF_PEA_1_P19, comprising a polypeptide being at least 70%, optionally at least about 80%, preferably at least about 85%, more preferably at least about 90% and most preferably at least about 95% homologous to the sequence VSLVGQG-GQGRAGILGTTAGPVYGPCPCCQPPAFPHL in HUMGCSF_PEA_1_P19.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGCSF_PEA_1_P19 also has the following non-silent SNPs (Single Nucleotide Polymorphisms) as listed in Table 398, (given according to their position(s) on the amino acid sequence, with the alternative amino acid(s) listed; the last column indicates whether the SNP is known or not; the presence of known SNPs in variant protein HUMGCSF_PEA_1_P19 sequence provides support for the deduced sequence of this variant protein according to the present invention).

TABLE 398

Amino acid mutations

| SNP position(s) on amino acid sequence | Alternative amino acid(s) | Previously known SNP? |
|---|---|---|
| 27 | T → | No |
| 56 | A → P | No |
| 56 | A → | No |
| 79 | Q → | No |
| 93 | G → C | No |
| 108 | T → A | No |
| 111 | W → R | No |
| 133 | G → R | Yes |
| 144 | P → A | Yes |

The glycosylation sites of variant protein HUMGCSF_PEA_1_P19, as compared to the known protein Granulocyte colony-stimulating factor precursor, are described in Table 399 (given according to their position(s) on the amino acid sequence in the first column; the second column indicates whether the glycosylation site is present in the variant protein; and the last column indicates whether the position is different on the variant protein).

TABLE 399

Glycosylation site(s)

| Position(s) on known amino acid sequence | Present in variant protein? | Position in variant protein? |
|---|---|---|
| 166 | no | |

The variant protein has the following domains, as determined by using InterPro. The domains are described in Table 400:

TABLE 400

InterPro domain(s)

| InterPro ID | Domain description | Analysis type | Position(s) on protein |
|---|---|---|---|
| IPR003573 | Interleukin-6/G-CSF/MGF | HMMSmart | 47-136 |
| IPR003629 | Granulocyte colony-stimulating/myelo-monocytic growth factor | BlastProDom | 65-111 |

Variant protein HUMGCSF_PEA_1_P19 is encoded by the following transcript(s): HUMGCSF_PEA_1_T19. The coding portion of transcript HUMGCSF_PEA_1_T19 starts at position 303 and ends at position 752. The transcript also has the following SNPs as listed in Table 401 (given according to their position on the nucleotide sequence, with the alternative nucleic acid listed; the last column indicates whether the SNP is known or not; the presence of known SNPs in variant protein HUMGCSF_PEA_1_P19 sequence provides support for the deduced sequence of this variant protein according to the present invention).

TABLE 401

Nucleic acid SNPs

| SNP position on nucleotide sequence | Alternative nucleic acid | Previously known SNP? |
|---|---|---|
| 55 | C → G | Yes |
| 99 | A → G | Yes |
| 382 | C → | No |
| 468 | G → | No |
| 468 | G → C | No |
| 539 | G → | No |
| 579 | G → T | No |
| 624 | A → G | No |
| 633 | T → C | No |
| 699 | G → A | Yes |
| 732 | C → G | Yes |
| 807 | T → C | No |
| 815 | C → A | Yes |
| 847 | G → | No |
| 866 | G → A | Yes |
| 901 | A → G | Yes |
| 1027 | G → A | No |
| 1111 | C → T | Yes |
| 1192 | A → G | Yes |
| 1243 | T → C | No |
| 1247 | C → | No |
| 1423 | C → | No |
| 1463 | C → | No |
| 1495 | C → T | Yes |
| 1550 | T → C | Yes |
| 1590 | G → A | Yes |
| 1660 | C → T | Yes |

Variant protein HUMGCSF_PEA_1_P20 (SEQ ID NO:1010) according to the present invention is encoded by transcript(s) HUMGCSF_PEA_1_T22. An alignment is given to the known protein (Granulocyte colony-stimulating factor precursor) in FIG. 249. One or more alignments to one or more previously published protein sequences are given in FIGS. 237-251. A brief description of the relationship of the variant protein according to the present invention to each such aligned protein is as follows:

Comparison Report Between HUMGCSF_PEA_1_P20 and CSF3_HUMAN:

1. An isolated chimeric polypeptide HUMGCSF_PEA_1_P20, comprising a first amino acid sequence being at least 70%, optionally at least 80%, preferably at least 85%, more preferably at least 90% and most preferably at least 95% homologous to a polypeptide having the sequence MSPEPALSP corresponding to amino acids 1-9 of HUMGCSF_PEA_1_P20, a second amino acid sequence being at least 90% homologous to ALQLLLWHSALWTVQEATPLGPASSLPQSFLLKCLEQVRKIQGDGAALQEKL VSECATYKLCHPEELVLLGHSLGIPWAPLSSCPSQALQL corresponding to amino acids 14-104 of CSF3_HUMAN, which also corresponds to amino acids 10-100 of HUMGCSF_PEA_1_P20, and a third amino acid sequence being at least 70%, optionally at least 80%, preferably at least 85%, more preferably at least 90% and most preferably at least 95% homologous to a polypeptide having the sequence VSVRKG corresponding to amino acids 101-106 of HUMGCSF_PEA_1_P20, wherein said first amino acid sequence, second amino acid sequence and third amino acid sequence are contiguous and in a sequential order.

2. An isolated polypeptide for a head of HUMGCSF_PEA_1_P20, comprising a polypeptide being at least 70%, optionally at least about 80%, preferably at least about 85%, more preferably at least about 90% and most preferably at least about 95% homologous to the sequence MSPEPALSP of HUMGCSF_PEA_1_P20.

3. An isolated polypeptide for a tail of HUMGCSF_PEA_1_P20, comprising a polypeptide being at least 70%, optionally at least about 80%, preferably at least about 85%, more preferably at least about 90% and most preferably at least about 95% homologous to the sequence VSVRKG in HUMGCSF_PEA_1_P20.

Comparison Report Between HUMGCSF_PEA_1_P20 and Q8N4W3:

1. An isolated chimeric polypeptide HUMGCSF_PEA_1_P20, comprising a first amino acid sequence being at least 90% homologous to MSPEPALSPALQLLLWHSALWTVQEATPLGPASSLPQSFLLKCLEQVRKIQGD GAALQEKL corresponding to amino acids 1-61 of Q8N4W3, which also corresponds to amino acids 1-61 of HUMGCSF_PEA_1_P20, a second amino acid sequence being at least 70%, optionally at least 80%, preferably at least 85%, more preferably at least 90% and most preferably at least 95% homologous to a polypeptide having the sequence VSE corresponding to amino acids 62-64 of HUMGCSF_PEA_1_P20, a third amino acid sequence being at least 90% homologous to CATYKLCHPEELVLLGHSLGIPWAPLSSCPSQALQL corresponding to amino acids 62-97 of Q8N4W3, which also corresponds to amino acids 65-100 of HUMGCSF_PEA_1_P20, and a fourth amino acid sequence being at least 70%, optionally at least 80%, preferably at least 85%, more preferably at least 90% and most preferably at least 95% homologous to a polypeptide having the sequence VSVRKG corresponding to amino acids 101-106 of HUMGCSF_PEA_1_P20, wherein said first amino acid sequence, second amino acid sequence, third amino acid sequence and fourth amino acid sequence are contiguous and in a sequential order.

2. An isolated polypeptide for an edge portion of HUMGCSF_PEA_1_P20, comprising an amino acid sequence being at least 70%, optionally at least about 80%, preferably at least about 85%, more preferably at least about 90% and most preferably at least about 95% homologous to the sequence encoding for VSE, corresponding to HUMGCSF_PEA_1_P20.

3. An isolated polypeptide for a tail of HUMGCSF_PEA_1_P20, comprising a polypeptide being at least 70%, optionally at least about 80%, preferably at least about 85%, more preferably at least about 90% and most preferably at least about 95% homologous to the sequence VSVRKG in HUMGCSF_PEA_1_P20.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGCSF_PEA_1_P20 also has the following non-silent SNPs (Single Nucleotide Polymorphisms) as listed in Table 402, (given according to their position(s) on the amino acid sequence, with the alternative amino acid(s) listed; the last column indicates whether the SNP is known or not; the presence of known SNPs in variant protein HUMGCSF_PEA_1_P20 sequence provides support for the deduced sequence of this variant protein according to the present invention).

TABLE 402

| Amino acid mutations | | |
| --- | --- | --- |
| SNP position(s) on amino acid sequence | Alternative amino acid(s) | Previously known SNP? |
| 27 | T → | No |
| 56 | A → | No |
| 56 | A → P | No |

The glycosylation sites of variant protein HUMGCSF_PEA_1_P20, as compared to the known protein Granulocyte colony-stimulating factor precursor, are described in Table 403 (given according to their position(s) on the amino acid sequence in the first column; the second column indicates whether the glycosylation site is present in the variant protein; and the last column indicates whether the position is different on the variant protein).

TABLE 403

| Glycosylation site(s) | | |
| --- | --- | --- |
| Position(s) on known amino acid sequence | Present in variant protein? | Position in variant protein? |
| 166 | no | |

The variant protein has the following domains, as determined by using InterPro. The domains are described in Table 404:

TABLE 404

InterPro domain(s)

| InterPro ID | Domain description | Analysis type | Position(s) on protein |
|---|---|---|---|
| IPR003573 | Interleukin-6/G-CSF/MGF | FPrintScan | 46-61, 65-88 |
| IPR003629 | Granulocyte colony-stimulating/myelo-monocytic growth factor | BlastProDom | 77-100 |

Variant protein HUMGCSF_PEA_1_P20 is encoded by the following transcript(s): HUMGCSF_PEA_1_T22. The coding portion of transcript HUMGCSF_PEA_1_T22 starts at position 303 and ends at position 620. The transcript also has the following SNPs as listed in Table 405 (given according to their position on the nucleotide sequence, with the alternative nucleic acid listed; the last column indicates whether the SNP is known or not; the presence of known SNPs in variant protein HUMGCSF_PEA_1_P20 sequence provides support for the deduced sequence of this variant protein according to the present invention).

TABLE 405

Nucleic acid SNPs

| SNP position on nucleotide sequence | Alternative nucleic acid | Previously known SNP? |
|---|---|---|
| 55 | C → G | Yes |
| 99 | A → G | Yes |
| 382 | C → | No |
| 468 | G → | No |
| 468 | G → C | No |
| 791 | G → | No |
| 831 | G → T | No |
| 876 | A → G | No |
| 885 | T → C | No |
| 895 | T → C | No |
| 903 | C → A | Yes |
| 935 | G → | No |
| 954 | G → A | Yes |
| 989 | A → G | Yes |
| 1115 | G → A | No |
| 1199 | C → T | Yes |
| 1280 | A → G | Yes |
| 1331 | T → C | No |
| 1335 | C → | No |
| 1511 | C → | No |
| 1551 | C → | No |
| 1583 | C → T | Yes |
| 1638 | T → C | Yes |
| 1678 | G → A | Yes |
| 1748 | C → T | Yes |

Variant protein HUMGCSF_PEA_1_P21 (SEQ ID NO:1011) according to the present invention is encoded by transcript(s) HUMGCSF_PEA_1_T17. An alignment is given to the known protein (Granulocyte colony-stimulating factor precursor) in FIG. 251. One or more alignments to one or more previously published protein sequences are given in FIGS. 237-251. A brief description of the relationship of the variant protein according to the present invention to each such aligned protein is as follows:

Comparison Report Between HUMGCSF_PEA_1_P21 and CSF3_HUMAN:

1. An isolated chimeric polypeptide HUMGCSF_PEA_1_P21, comprising a first amino acid sequence being at least 90% homologous to MAGPATQSPMKLMALQLLLWH-SALWTVQEATPLGPASSLPQSFLLKCLEQV RKIQGD-GAALQEKL corresponding to amino acids 1-65 of CSF3_HUMAN, which also corresponds to amino acids 1-65 of HUMGCSF_PEA_1_P21, a second amino acid sequence being at least 90% homologous to CATYKLCHPEELV-LLGHSLGIPWAPLSSCPSQALQL corresponding to amino acids 69-104 of CSF3_HUMAN, which also corresponds to amino acids 66-101 of HUMGCSF_PEA_1_P21, and a third amino acid sequence being at least 70%, optionally at least 80%, preferably at least 85%, more preferably at least 90% and most preferably at least 95% homologous to a polypeptide having the sequence VSVRKG corresponding to amino acids 102-107 of HUMGCSF_PEA_1_P21, wherein said first amino acid sequence, second amino acid sequence and third amino acid sequence are contiguous and in a sequential order.

2. An isolated chimeric polypeptide for an edge portion of HUMGCSF_PEA_1_P21, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LC, having a structure as follows: a sequence starting from any of amino acid numbers 65-x to 65; and ending at any of amino acid numbers 66+((n−2)−x), in which x varies from 0 to n−2.

3. An isolated polypeptide for a tail of HUMGCSF_PEA_1_P21, comprising a polypeptide being at least 70%, optionally at least about 80%, preferably at least about 85%, more preferably at least about 90% and most preferably at least about 95% homologous to the sequence VSVRKG in HUMGCSF_PEA_1_P21.

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMGCSF_PEA_1_P21 also has the following non-silent SNPs (Single Nucleotide Polymorphisms) as listed in Table 406, (given according to their position(s) on the amino acid sequence, with the alternative amino acid(s) listed; the last column indicates whether the SNP is known or not; the presence of known SNPs in variant protein HUMGCSF_PEA_1_P21 sequence provides support for the deduced sequence of this variant protein according to the present invention).

TABLE 406

Amino acid mutations

| SNP position(s) on amino acid sequence | Alternative amino acid(s) | Previously known SNP? |
|---|---|---|
| 31 | T → | No |
| 60 | A → | No |
| 60 | A → P | No |

The glycosylation sites of variant protein HUMGCSF_PEA_1_P21, as compared to the known protein Granulocyte colony-stimulating factor precursor, are described in Table 407 (given according to their position(s) on the amino acid sequence in the first column; the second column indicates whether the glycosylation site is present in the variant protein; and the last column indicates whether the position is different on the variant protein).

TABLE 407

| Glycosylation site(s) | | |
|---|---|---|
| Position(s) on known amino acid sequence | Present in variant protein? | Position in variant protein? |
| 166 | no | |

The variant protein has the following domains, as determined by using InterPro. The domains are described in Table 408:

TABLE 408

| InterPro domain(s) | | | |
|---|---|---|---|
| InterPro ID | Domain description | Analysis type | Position(s) on protein |
| IPR003573 | Interleukin-6/G-CSF/MGF | FPrintScan | 50-65, 66-89 |
| IPR003629 | Granulocyte colony-stimulating/myelomonocytic growth factor | BlastProDom | 78-101 |

Variant protein HUMGCSF_PEA_1_P21 is encoded by the following transcript(s): HUMGCSF_PEA_1_T17. The coding portion of transcript HUMGCSF_PEA_1_T17 starts at position 115 and ends at position 435. The transcript also has the following SNPs as listed in Table 409 (given according to their position on the nucleotide sequence, with the alternative nucleic acid listed; the last column indicates whether the SNP is known or not; the presence of known SNPs in variant protein HUMGCSF_PEA_1_P21 sequence provides support for the deduced sequence of this variant protein according to the present invention).

TABLE 409

| Nucleic acid SNPs | | |
|---|---|---|
| SNP position on nucleotide sequence | Alternative nucleic acid | Previously known SNP? |
| 55 | C → G | Yes |
| 99 | A → G | Yes |
| 206 | C → | No |
| 292 | G → | No |
| 292 | G → C | No |
| 606 | G → | No |
| 646 | G → T | No |
| 691 | A → G | No |
| 700 | T → C | No |
| 766 | G → A | Yes |
| 799 | C → G | Yes |
| 874 | T → C | No |
| 882 | C → A | Yes |
| 914 | G → | No |
| 933 | G → A | Yes |
| 968 | A → G | Yes |
| 1094 | G → A | No |
| 1178 | C → T | Yes |
| 1259 | A → G | Yes |
| 1310 | T → C | No |
| 1314 | C → | No |
| 1490 | C → | No |
| 1530 | C → | No |
| 1562 | C → T | Yes |
| 1617 | T → C | Yes |

TABLE 409-continued

| Nucleic acid SNPs | | |
|---|---|---|
| SNP position on nucleotide sequence | Alternative nucleic acid | Previously known SNP? |
| 1657 | G → A | Yes |
| 1727 | C → T | Yes |

FIG. 236 depicts the domain structure of the variants described hereinabove in comparison to the known or wild-type (WT) GCSF protein.

Example 65

Description for Cluster HSTGFB1

Cluster HSTGFB1 features 6 transcript(s) and 24 segment(s) of interest, the names for which are given in Tables 410 and 411, respectively. The selected protein variants are given in Table 412.

TABLE 410

| Transcripts of interest | |
|---|---|
| Transcript Name | SEQ ID NO: |
| HSTGFB1_PEA_1_T5 | 1013 |
| HSTGFB1_PEA_1_T6 | 1014 |
| HSTGFB1_PEA_1_T8 | 1015 |
| HSTGFB1_PEA_1_T9 | 1016 |
| HSTGFB1_PEA_1_T11 | 1017 |
| HSTGFB1_PEA_1_T14 | 1018 |

TABLE 411

| Segments of interest | |
|---|---|
| Segment Name | SEQ ID NO: |
| HSTGFB1_PEA_1_node_0 | 1019 |
| HSTGFB1_PEA_1_node_2 | 1020 |
| HSTGFB1_PEA_1_node_3 | 1021 |
| HSTGFB1_PEA_1_node_4 | 1022 |
| HSTGFB1_PEA_1_node_7 | 1023 |
| HSTGFB1_PEA_1_node_9 | 1024 |
| HSTGFB1_PEA_1_node_15 | 1025 |
| HSTGFB1_PEA_1_node_22 | 1026 |
| HSTGFB1_PEA_1_node_26 | 1027 |
| HSTGFB1_PEA_1_node_28 | 1028 |
| HSTGFB1_PEA_1_node_31 | 1029 |
| HSTGFB1_PEA_1_node_33 | 1030 |
| HSTGFB1_PEA_1_node_1 | 1031 |
| HSTGFB1_PEA_1_node_5 | 1032 |

TABLE 411-continued

Segments of interest

| Segment Name | SEQ ID NO: |
|---|---|
| HSTGFB1_PEA_1_node_11 | 1033 |
| HSTGFB1_PEA_1_node_14 | 1034 |
| HSTGFB1_PEA_1_node_16 | 1035 |
| HSTGFB1_PEA_1_node_17 | 1036 |
| HSTGFB1_PEA_1_node_18 | 1037 |
| HSTGFB1_PEA_1_node_19 | 1038 |
| HSTGFB1_PEA_1_node_23 | 1039 |
| HSTGFB1_PEA_1_node_25 | 1040 |
| HSTGFB1_PEA_1_node_27 | 1041 |
| HSTGFB1_PEA_1_node_30 | 1042 |

TABLE 412

Proteins of interest

| Protein Name | SEQ ID NO: | Protein Length | Corresponding Transcript(s) |
|---|---|---|---|
| HSTGFB1_PEA_1_P2 | 1043 | P248 | HSTGFB1_PEA_1_T5 |
| HSTGFB1_PEA_1_P3 | 1044 | P363 | HSTGFB1_PEA_1_T6 |
| HSTGFB1_PEA_1_P5 | 1045 | P357 | HSTGFB1_PEA_1_T8; HSTGFB1_PEA_1_T9 |
| HSTGFB1_PEA_1_P7 | 1046 | P332 | HSTGFB1_PEA_1_T11 |
| HSTGFB1_PEA_1_P10 | 1047 | P370 | HSTGFB1_PEA_1_T14 |

These sequences are variants of the known protein Transforming growth factor beta 1 precursor (SwissProt accession identifier TGF1_HUMAN, SEQ ID NO:1048; known also according to the synonyms TGF-beta 1), referred to herein as the previously known protein.

Protein Transforming growth factor beta 1 precursor is known or believed to have the following function(s): Multifunctional peptide that controls proliferation, differentiation, and other functions in many cell types. Many cells synthesize TGF-beta 1 and essentially all of them have specific receptors for this peptide. TGF-beta 1 regulates the actions of many other peptide growth factors and determines a positive or negative direction of their effects. Play an important role in bone remodelling. It is a potent stimulator of osteoblastic bone formation, causing chemotaxis, proliferation and differentiation in committed osteoblasts (By similarity). The sequence for protein Transforming growth factor beta 1 precursor is set forth by SEQ ID NO:1048, as "Transforming growth factor beta 1 precursor amino acid sequence". Known polymorphisms for this sequence are as shown in Table 413.

TABLE 413

Amino acid mutations for Known Protein

| SNP position(s) on amino acid sequence | Comment |
|---|---|
| 10 | L → P (associated with higher bone mineral density and lower frequency of vertebral fractures in Japanese post-menopausal women; dbSNP: 1982073)./FTId = VAR_016171. |
| 25 | R → P (in dbSNP: 1800471)./FTId = VAR_016172. |
| 81 | Y → H (in CED; leads to TGF-beta 1 intracellular accumulation)./FTId = VAR_017607. |
| 218 | R → C (in CED; higher levels of active TGF-beta 1 in the culture medium; enhances osteoclast formation in vitro)./FTId = VAR_017608. |
| 218 | R → H (in CED)./FTId = VAR_017609. |
| 222 | H → D (in CED; sporadic case; higher levels of active TGF-beta 1 in the culture medium)./FTId = VAR_017610. |
| 225 | C → R (in CED; higher levels of active TGF-beta 1 in the culture medium)./FTId = VAR_017611. |
| 263 | T → I (in dbSNP: 1800472)./FTId = VAR_016173. |
| 159 | R → RR |

Protein Transforming growth factor beta 1 precursor localization is believed to be Secreted.

The previously known protein also has the following indication(s) and/or potential therapeutic use(s): Cancer, breast; Cancer, colorectal; Multiple sclerosis; Eczema; Lupus erythematosus; Psoriasis. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein or of drugs directed against this protein are as follows: Immunosuppressant; Transforming growth factor beta agonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Vulnerary; Cytokine; Immunosuppressant; Anticancer; Antidiabetic; Antipruritic/inflamm, allergic; Antipsoriasis; Multiple sclerosis.

The following GO Annotation(s) apply to the previously known protein. The following annotation(s) were found: cell cycle control; anti-apoptosis; TGFbeta receptor signaling pathway; cell-cell signaling; cell proliferation; cell growth; growth, which are annotation(s) related to Biological Process; and transforming growth factor beta receptor ligand, which are annotation(s) related to Molecular Function.

The GO assignment relies on information from one or more of the SwissProt/TremB1 Protein knowledgebase, or Locuslink.

This protein belongs to the 'TGF-β superfamily' which regulates epithelial cell growth, differentiation, motility, organization, apoptosis and tumorogenesis. Some members participate in early embryogenesis, while others play an important role in bone formation and remodelling.

There are three isoforms of TGF-β: TGF-β1, TGF-β2 and TGF-β3, which all bind to the same Type II receptor, TGFBR2. Almost every cell produces TGF-β1 and its receptor. TGF-β1 is secreted in an inactive form, consisting of TGF-β1 non-covalently linked to its propeptide-LAP. After its secretion most TGF-β is stored in the ECM as a complex of TGF-β, LAP and a latent TGF-β-binding protein. Activation of TGF-β requires its release by MMPs or plasmin.

In normal cells TGF-beta acts as a tumor suppressor. In the initial stages of tumorigenesis, the cell loses its TGF-β-mediated growth inhibition, resulting in uncontrolled proliferation. The TGF-β-resistant cancer cells then increase their production of TGF-β. This TGF-β, by acting on the surrounding stromal cells, immune cells and endothelial and smooth-muscle cells, causes immunosuppression and angiogenesis and increases the invasiveness of the tumor.

FIG. 252 depicts TGF beta clinical studies and FIG. 253 depicts TGF beta preclinical studies.

As noted above, cluster HSTGFB1 features 6 transcript(s), which were listed in Table 1 above. These transcript(s) encode for protein(s) which are variant(s) of protein Transforming growth factor beta 1 precursor. A description of each variant protein according to the present invention is now provided.

Variant protein HSTGFB1_PEA_1_P2 (SEQ ID NO:1043) according to the present invention is encoded by transcript(s) HSTGFB1_1_PEA_1_T5. An alignment is given to the known protein (Transforming growth factor beta 1 precursor) in FIG. 255. One or more alignments to one or more previously published protein sequences are given in FIGS. 255-259. A brief description of the relationship of the variant protein according to the present invention to each such aligned protein is as follows:

Comparison Report Between HSTGFB1_PEA_1_P2 and TGF1_HUMAN:

1. An isolated chimeric polypeptide HSTGFB1_PEA_1_P2, comprising a first amino acid sequence being at least 90% homologous to MPPSGLRLLLLLLPLLWLLVLT-PGRPAAGLSTCKTIDMELVKRKRIEAIRGQIL SKLR-LASPPSQGEVPPGPLPEAVLALYN-STRDRVAGESAEPEPEPEADYYAKE VTRVLMVETHNEIYDKFKQSTHSIYM-FFNTSELREAVPEPVLLSRAELRLLRL KLKVEQHVE-LYQKYSNNSWRYLSNRLLAPSD-SPEWLSEDVTGVVRQWLSRG GEIEGFRLSAHCSCDSRDNTLQVDING corresponding to amino acids 1-238 of TGF1_HUMAN, which also corresponds to amino acids 1-238 of HSTGFB1_PEA_1_P2, and a second amino acid sequence being at least 70%, optionally at least 80%, preferably at least 85%, more preferably at least 90% and most preferably at least 95% homologous to a polypeptide having the sequence EACFPGHAQL corresponding to amino acids 239-248 of HSTGFB1_PEA_1_P2, wherein said first amino acid sequence and second amino acid sequence are contiguous and in a sequential order.

2. An isolated polypeptide for a tail of HSTGFB1_PEA_1_P2, comprising a polypeptide being at least 70%, optionally at least about 80%, preferably at least about 85%, more preferably at least about 90% and most preferably at least about 95% homologous to the sequence EACFPGHAQL in HSTGFB1_PEA_1_P2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSTGFB1_PEA_1_P2 also has the following non-silent SNPs (Single Nucleotide Polymorphisms) as listed in Table 414, (given according to their position(s) on the amino acid sequence, with the alternative amino acid(s) listed; the last column indicates whether the SNP is known or not; the presence of known SNPs in variant protein HSTGFB1_PEA_1_P2 sequence provides support for the deduced sequence of this variant protein according to the present invention).

TABLE 414

Amino acid mutations

| SNP position(s) on amino acid sequence | Alternative amino acid(s) | Previously known SNP? |
|---|---|---|
| 10 | L → P | Yes |
| 25 | R → P | Yes |
| 47 | E → G | Yes |
| 65 | Q → | No |
| 136 | N → H | No |
| 230 | N → Y | No |
| 230 | N → | No |

The glycosylation sites of variant protein HSTGFB1_PEA_1_P2, as compared to the known protein Transforming growth factor beta 1 precursor, are described in Table 415 (given according to their position(s) on the amino acid sequence in the first column; the second column indicates whether the glycosylation site is present in the variant protein; and the last column indicates whether the position is different on the variant protein).

TABLE 415

Glycosylation site(s)

| Position(s) on known amino acid sequence | Present in variant protein? | Position in variant protein? |
|---|---|---|
| 82 | yes | 82 |
| 136 | yes | 136 |
| 176 | yes | 176 |

The variant protein has the following domains, as determined by using InterPro. The domains are described in Table 416:

TABLE 416

| | InterPro domain(s) | | |
|---|---|---|---|
| InterPro ID | Domain description | Analysis type | Position(s) on protein |
| IPR003911 | Transforming growth factor beta TGFb | FPrintScan | 163-177, 17-36, 178-193, 195-209, 72-84 |
| IPR003939 | Transforming growth factor, beta 1 | FPrintScan | 12-31, 135-154, 166-177, 207-219, 34-43 |
| IPR001111 | Transforming growth factor beta (TGFb), N-terminal | HMMPfam | 33-238 |

Variant protein HSTGFB1_PEA_1_P2 is encoded by the following transcript(s): HSTGFB1_PEA_1_T5. The coding portion of transcript HSTGFB1_PEA_1_T5 starts at position 1038 and ends at position 1781. The transcript also has the following SNPs as listed in Table 417 (given according to their position on the nucleotide sequence, with the alternative nucleic acid listed; the last column indicates whether the SNP is known or not; the presence of known SNPs in variant protein HSTGFB1_PEA_1_P2 sequence provides support for the deduced sequence of this variant protein according to the present invention).

TABLE 417

| | Nucleic acid SNPs | |
|---|---|---|
| SNP position on nucleotide sequence | Alternative nucleic acid | Previously known SNP? |
| 181 | C → A | Yes |
| 205 | C → T | Yes |
| 206 | T → A | Yes |
| 211 | G → C | Yes |
| 214 | G → | No |
| 289 | C → | No |
| 390 | G → C | Yes |
| 585 | G → A | Yes |
| 651 | C → T | Yes |
| 762 | C → A | Yes |
| 789 | C → A | Yes |
| 896 | C → T | Yes |
| 1024 | G → A | Yes |
| 1030 | C → | No |
| 1030 | C → T | No |
| 1066 | T → C | Yes |
| 1111 | G → C | Yes |
| 1177 | A → G | Yes |
| 1232 | G → | No |
| 1443 | A → C | No |
| 1725 | A → | No |
| 1725 | A → T | No |
| 1964 | C → T | Yes |
| 2139 | C → T | Yes |
| 2148 | G → A | Yes |
| 2149 | C → | No |
| 2254 | G → | No |
| 2254 | G → C | No |
| 2255 | C → | No |
| 2255 | C → G | No |
| 2286 | G → | No |
| 2317 | A → | No |
| 2317 | A → C | No |
| 2353 | C → T | No |
| 2408 | C → T | No |

Variant protein HSTGFB1_PEA_1_P3 (SEQ ID NO:1044) according to the present invention is encoded by transcript(s) HSTGFB1_PEA_1_T6. An alignment is given to the known protein (Transforming growth factor beta 1 precursor) in FIG. 256. One or more alignments to one or more previously published protein sequences are given in FIGS. 255-259. A brief description of the relationship of the variant protein according to the present invention to each such aligned protein is as follows:

Comparison Report Between HSTGFB1_PEA_1_P3 and TGF1_HUMAN:

1. An isolated chimeric polypeptide HSTGFB1_PEA_1_P3, comprising a first amino acid sequence being at least 90% homologous to MPPSGLRLLLLLLPLLWLLVLT-PGRPAAGLSTCKTIDMELVKRKRIEAIRGQIL SKLR-LASPPSQGEVPPGPLPEAVLALYN-STRDRVAGESAEPEPEPEADYYAKE VTRVLMVETHNEIYDKFKQSTHSIYM-FFNTSELREAVPEPVLLSRAELRLLRL KLKVEQHVE-LYQKYSNNSWRYLSNRLLAPSDSPEWLS-FDVTGVVRQWLSRG GEIEGFRLSAHCSCDSRDNTLQVDING-FTTGRRGDLATIHGMNRPFLLLMATP LERAQHLQSS-RHRRALDTNYCFSSTEKNCCVRQLYID-FRKDLGWKWIHEPKG YHANFCLGPCPYIWSLDTQYSKV corresponding to amino acids 1-339 of TGF1_HUMAN, which also corresponds to amino acids 1-339 of HSTGFB1_PEA_1_P3, and a second amino acid sequence being at least 70%, optionally at least 80%, preferably at least 85%, more preferably at least 90% and most preferably at least 95% homologous to a polypeptide having the sequence RLAHRATR-CAWGEPGRRKRREKEK corresponding to amino acids 340-363 of HSTGFB1_PEA_1_P3, wherein said first amino acid sequence and second amino acid sequence are contiguous and in a sequential order.

2. An isolated polypeptide for a tail of HSTGFB1_PEA_1_P3, comprising a polypeptide being at least 70%, optionally at least about 80%, preferably at least about 85%, more preferably at least about 90% and most preferably at least about 95% homologous to the sequence RLAHRATR-CAWGEPGRRKRREKEK in HSTGFB1_PEA_1_P3.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSTGFB1_PEA_1_P3 also has the following non-silent SNPs (Single Nucleotide Polymorphisms) as listed in Table 418, (given according to their position(s) on the amino acid sequence, with the alternative amino acid(s) listed; the last column indicates whether the SNP is known or not; the presence of known SNPs in variant protein HSTGFB1_PEA_1_P3 sequence provides support for the deduced sequence of this variant protein according to the present invention).

TABLE 418

Amino acid mutations

| SNP position(s) on amino acid sequence | Alternative amino acid(s) | Previously known SNP? |
|---|---|---|
| 10 | L → P | Yes |
| 25 | R → P | Yes |
| 47 | E → G | Yes |
| 65 | Q → | No |
| 136 | N → H | No |
| 230 | N → Y | No |
| 230 | N → | No |
| 263 | T → I | Yes |
| 325 | P → | No |

The glycosylation sites of variant protein HSTGFB1_PEA_1_P3, as compared to the known protein Transforming growth factor beta 1 precursor, are described in Table 419 (given according to their position(s) on the amino acid sequence in the first column; the second column indicates whether the glycosylation site is present in the variant protein; and the last column indicates whether the position is different on the variant protein).

TABLE 419

Glycosylation site(s)

| Position(s) on known amino acid sequence | Present in variant protein? | Position in variant protein? |
|---|---|---|
| 82 | yes | 82 |
| 136 | yes | 136 |
| 176 | yes | 176 |

The variant protein has the following domains, as determined by using InterPro. The domains are described in Table 420:

TABLE 420

InterPro domain(s)

| InterPro ID | Domain description | Analysis type | Position(s) on protein |
|---|---|---|---|
| IPR003911 | Transforming growth factor beta TGFb | FPrintScan | 163-177, 17-36, 178-193, 195-209, 72-84 |
| IPR003939 | Transforming growth factor, beta 1 | FPrintScan | 12-31, 135-154, 166-177, 207-219, 264-275, 34-43 |
| IPR001839 | Transforming growth factor beta | HMMPfam | 290-341 |
| IPR001111 | Transforming growth factor beta (TGFb), N-terminal | HMMPfam | 33-252 |
| IPR001839 | Transforming growth factor beta | HMMSmart | 293-351 |
| IPR001839 | Transforming growth factor beta | ScanRegExp | 311-326 |
| IPR001839 | Transforming growth factor beta | BlastProDom | 279-339 |
| IPR001839 | Transforming growth factor beta | ProfileScan | 289-328 |

Variant protein HSTGFB1_PEA_1_P3 is encoded by the following transcript(s): HSTGFB1_PEA_1_T6. The coding portion of transcript HSTGFB1_PEA_1_T6 starts at position 1038 and ends at position 2126. The transcript also has the following SNPs as listed in Table 421 (given according to their position on the nucleotide sequence, with the alternative nucleic acid listed; the last column indicates whether the SNP is known or not; the presence of known SNPs in variant protein HSTGFB1_PEA_1_P3 sequence provides support for the deduced sequence of this variant protein according to the present invention).

TABLE 421

Nucleic acid SNPs

| SNP position on nucleotide sequence | Alternative nucleic acid | Previously known SNP? |
|---|---|---|
| 181 | C → A | Yes |
| 205 | C → T | Yes |
| 206 | T → A | Yes |
| 211 | G → C | Yes |
| 214 | G → | No |
| 289 | C → | No |
| 390 | G → C | Yes |
| 585 | G → A | Yes |
| 651 | C → T | Yes |
| 762 | C → A | Yes |
| 789 | C → A | Yes |
| 896 | C → T | Yes |
| 1024 | G → A | Yes |
| 1030 | C → | No |
| 1030 | C → T | No |
| 1066 | T → C | Yes |
| 1111 | G → C | Yes |
| 1177 | A → G | Yes |
| 1232 | G → | No |
| 1443 | A → C | No |
| 1725 | A → | No |
| 1725 | A → T | No |
| 1825 | C → T | Yes |
| 2000 | C → T | Yes |
| 2009 | G → A | Yes |
| 2010 | C → | No |
| 2203 | G → | No |
| 2203 | G → C | No |
| 2204 | C → | No |
| 2204 | C → G | No |

TABLE 421-continued

Nucleic acid SNPs

| SNP position on nucleotide sequence | Alternative nucleic acid | Previously known SNP? |
|---|---|---|
| 2235 | G → | No |
| 2266 | A → | No |
| 2266 | A → C | No |
| 2302 | C → T | No |
| 2357 | C → T | No |

Variant protein HSTGFB1_PEA_1_P5 (SEQ ID NO:1045) according to the present invention is encoded by transcript(s) HSTGFB1_PEA_1_T8. An alignment is given to the known protein (Transforming growth factor beta 1 precursor) in FIG. 257. One or more alignments to one or more previously published protein sequences are given in FIGS. 255-259. A brief description of the relationship of the variant protein according to the present invention to each such aligned protein is as follows:

Comparison Report Between HSTGFB1_PEA_1_P5 and TGF1_HUMAN:

1. An isolated chimeric polypeptide HSTGFB1_PEA_1_P5, comprising a first amino acid sequence being at least 90% homologous to MPPSGLRLLLLLLPLLWLLVLT-PGRPAAGLSTCKTIDMELVKRKRIEAIRGQIL SKLR-LASPPSQGEVPPGPLPEAVLALYN-STRDRVAGESAEPEPEPEADYYAKE VTRVLMVETHNEIYDKFKQSTHSIYM-FFNTSELREAVPEPVLLSRAELRLLRL KLKVEQHVE-LYQKYSNNSWRYLSNRLLAPSDSPEWLS-FDVTGVVRQWLSRG GEIEGFRLSAHCSCDSRDNTLQVDING-FTTGRRGDLATIHGMNRPFLLLMATP LERAQHLQSS-RHRRALDTNYCFSSTEKNCCVRQLYID-FRKDLGWKWIHEPKG YHANFCLGPCPYIWSLDTQYSK corresponding to amino acids 1-338 of TGF1_HUMAN, which also corresponds to amino acids 1-338 of HSTGFB1_PEA_1_P5, and a second amino acid sequence being at least 70%, optionally at least 80%, preferably at least 85%, more preferably at least 90% and most preferably at least 95% homologous to a polypeptide having the sequence LNEQNLIQEVPNIWQREVG corresponding to amino acids 339-357 of HSTGFB1_PEA_1_P5, wherein said first amino acid sequence and second amino acid sequence are contiguous and in a sequential order.

2. An isolated polypeptide for a tail of HSTGFB1_PEA_1_P5, comprising a polypeptide being at least 70%, optionally at least about 80%, preferably at least about 85%, more preferably at least about 90% and most preferably at least about 95% homologous to the sequence LNEQNLIQEVPNIWQREVG in HSTGFB1_PEA_1_P5.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

The glycosylation sites of variant protein HSTGFB1_PEA_1_P5, as compared to the known protein Transforming growth factor beta 1 precursor, are described in Table 422 (given according to their position(s) on the amino acid sequence in the first column; the second column indicates whether the glycosylation site is present in the variant protein; and the last column indicates whether the position is different on the variant protein).

TABLE 422

Glycosylation site(s)

| Position(s) on known amino acid sequence | Present in variant protein? | Position in variant protein? |
|---|---|---|
| 82 | yes | 82 |
| 136 | yes | 136 |
| 176 | yes | 176 |

The variant protein has the following domains, as determined by using InterPro. The domains are described in Table 423:

TABLE 423

InterPro domain(s)

| InterPro ID | Domain description | Analysis type | Position(s) on protein |
|---|---|---|---|
| IPR003911 | Transforming growth factor beta TGFb | FPrintScan | 163-177, 17-36, 178-193, 195-209, 72-84 |
| IPR003939 | Transforming growth factor, beta 1 | FPrintScan | 12-31, 135-154, 166-177, 207-219, 264-275, 34-43 |
| IPR001839 | Transforming growth factor beta | HMMPfam | 290-338 |
| IPR001111 | Transforming growth factor beta (TGFb), N-terminal | HMMPfam | 33-252 |
| IPR001839 | Transforming growth factor beta | HMMSmart | 293-357 |
| IPR001839 | Transforming growth factor beta | ScanRegExp | 311-326 |
| IPR001839 | Transforming growth factor beta | BlastProDom | 279-339 |
| IPR001839 | Transforming growth factor beta | ProfileScan | 289-328 |

TABLE 423-continued

InterPro domain(s)

| InterPro ID | Domain description | Analysis type | Position(s) on protein |
|---|---|---|---|
| IPR003911 | Transforming growth factor beta TGFb | FPrintScan | 163-177, 17-36, 178-193, 195-209, 72-84 |
| IPR003939 | Transforming growth factor, beta 1 | FPrintScan | 12-31, 135-154, 166-177, 207-219, 264-275, 34-43 |
| IPR001839 | Transforming growth factor beta | HMMPfam | 290-338 |
| IPR001111 | Transforming growth factor beta (TGFb), N-terminal | HMMPfam | 33-252 |
| IPR001839 | Transforming growth factor beta | HMMSmart | 293-357 |
| IPR001839 | Transforming growth factor beta | ScanRegExp | 311-326 |
| IPR001839 | Transforming growth factor beta | BlastProDom | 279-339 |
| IPR001839 | Transforming growth factor beta | ProfileScan | 289-328 |

Variant protein HSTGFB1_PEA_1_P5 is encoded by the following transcript(s): HSTGFB1_PEA_1_T8. The coding portion of transcript HSTGFB1_PEA_1_T8 starts at position 1038 and ends at position 2108. The transcript also has the following SNPs as listed in Table 424 (given according to their position on the nucleotide sequence, with the alternative nucleic acid listed; the last column indicates whether the SNP is known or not; the presence of known SNPs in variant protein HSTGFB1_PEA_1_P5 sequence provides support for the deduced sequence of this variant protein according to the present invention).

TABLE 424

Nucleic acid SNPs

| SNP position on nucleotide sequence | Alternative nucleic acid | Previously known SNP? |
|---|---|---|
| 181 | C → A | Yes |
| 205 | C → T | Yes |
| 206 | T → A | Yes |
| 211 | G → C | Yes |
| 214 | G → | No |
| 289 | C → | No |
| 390 | G → C | Yes |
| 585 | G → A | Yes |
| 651 | C → T | Yes |
| 762 | C → A | Yes |
| 789 | C → A | Yes |
| 896 | C → T | Yes |
| 1024 | G → A | Yes |
| 1030 | C → | No |
| 1030 | C → T | No |
| 1066 | T → C | Yes |
| 1111 | G → C | Yes |
| 1177 | A → G | Yes |
| 1232 | G → | No |
| 1443 | A → C | No |
| 1725 | A → | No |
| 1725 | A → T | No |
| 1825 | C → T | Yes |
| 2000 | C → T | Yes |
| 2009 | G → A | Yes |
| 2010 | C → | No |

Variant protein HSTGFB1_PEA_1_P7 (SEQ ID NO:1046) according to the present invention is encoded by transcript(s) HSTGFB1_PEA_1_T11. An alignment is given to the known protein (Transforming growth factor beta 1 precursor) in FIG. 258. One or more alignments to one or more previously published protein sequences are given in FIGS. 255-259. A brief description of the relationship of the variant protein according to the present invention to each such aligned protein is as follows:

Comparison Report Between HSTGFB1_PEA_1_P7 and TGF1A_HUMAN:

1. An isolated chimeric polypeptide HSTGFB1_PEA_1_P7, comprising a first amino acid sequence being at least 90% homologous to MPPSGLRLLLLLLPLLWLLVLTPGRPAAGLSTCKTIDMELVKRKRIEAIRGQIL SKLRLASPPSQGEVPPGPLPEAVLALYN-STRDRVAGESAEPEPEPEADYYAKE VTRVLMVETHNEIYDKFKQSTHSIYM-FFNTSELREAVPEPVLLSRAELRLLRL KLKVEQHVELYQKYSNNSWRYLSNRLLAPSD-SPEWLSEDVTGVVRQWLSRG GEIEGFRLSAHCSCDSRDNTLQVDIN corresponding to amino acids 1-237 of TGF1_HUMAN, which also corresponds to amino acids 1-237 of HSTGFB1_PEA_1_P7, and a second amino acid sequence being at least 70%, optionally at least 80%, preferably at least 85%, more preferably at least 90% and most preferably at least 95% homologous to a polypeptide having the sequence APRRRTAACGSCTLTSARTSAGSGSTSPRATMPTSASGPAPTF-GAWTRSTARS WPCTTSITRAPRRRRAACRRRWSRCPSCTTWAASPRWSSCPT corresponding to amino acids 238-332 of HSTGFB1_PEA_1_P7, wherein said first amino acid sequence and second amino acid sequence are contiguous and in a sequential order.

2. An isolated polypeptide for a tail of HSTGFB1_PEA_1_P7, comprising a polypeptide being at least 70%, optionally at least about 80%, preferably at least about 85%, more preferably at least about 90% and most preferably at least about 95% homologous to the sequence APRRRTAACG-SCTLTSARTSAGSGSTSPRATMPTSASG-PAPTFGAWTRSTARS WPCTTSITRAPRRRRAACR-RRWSRCPSCTTWAASPRWSSCPT in HSTGFB1_PEA_1_P7.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSTGFB1_PEA_1_P7 also has the following non-silent SNPs (Single Nucleotide Polymorphisms) as listed in Table 425, (given according to their position(s) on the amino acid sequence, with the alternative amino acid(s) listed; the last column indicates whether the SNP is known or not; the presence of known SNPs in variant protein HSTGFB1_PEA_1_P7 sequence provides support for the deduced sequence of this variant protein according to the present invention).

TABLE 425

Amino acid mutations

| SNP position(s) on amino acid sequence | Alternative amino acid(s) | Previously known SNP? |
|---|---|---|
| 10 | L → P | Yes |
| 25 | R → P | Yes |
| 47 | E → G | Yes |
| 65 | Q → | No |
| 136 | N → H | No |
| 230 | N → Y | No |
| 230 | N → | No |
| 272 | S → F | Yes |
| 275 | G → D | Yes |
| 275 | G → | No |
| 310 | R → S | No |
| 310 | R → | No |
| 311 | R → | No |
| 311 | R → G | No |
| 321 | W → | No |
| 331 | P → | No |

The glycosylation sites of variant protein HSTGFB1_PEA_1_P7, as compared to the known protein Transforming growth factor beta 1 precursor, are described in Table 426 (given according to their position(s) on the amino acid sequence in the first column; the second column indicates whether the glycosylation site is present in the variant protein; and the last column indicates whether the position is different on the variant protein).

TABLE 426

Glycosylation site(s)

| Position(s) on known amino acid sequence | Present in variant protein? | Position in variant protein? |
|---|---|---|
| 82 | yes | 82 |
| 136 | yes | 136 |
| 176 | yes | 176 |

The variant protein has the following domains, as determined by using InterPro. The domains are described in Table 427:

TABLE 427

InterPro domain(s)

| InterPro ID | Domain description | Analysis type | Position(s) on protein |
|---|---|---|---|
| IPR003911 | Transforming growth factor beta TGFb | FPrintScan | 163-177, 17-36, 178-193, 195-209, 72-84 |
| IPR003939 | Transforming growth factor, beta 1 | FPrintScan | 12-31, 135-154, 166-177, 207-219, 34-43 |
| IPR001111 | Transforming growth factor beta (TGFb), N-terminal | HMMPfam | 33-236 |

Variant protein HSTGFB1_PEA_1_P7 is encoded by the following transcript(s): HSTGFB1_PEA_1_T11. The coding portion of transcript HSTGFB1_PEA_1_T11 starts at position 1038 and ends at position 2033. The transcript also has the following SNPs as listed in Table 428 (given according to their position on the nucleotide sequence, with the alternative nucleic acid listed; the last column indicates whether the SNP is known or not; the presence of known SNPs in variant protein HSTGFB1_PEA_1_P7 sequence provides support for the deduced sequence of this variant protein according to the present invention).

TABLE 428

Nucleic acid SNPs

| SNP position on nucleotide sequence | Alternative nucleic acid | Previously known SNP? |
|---|---|---|
| 181 | C → A | Yes |
| 205 | C → T | Yes |
| 206 | T → A | Yes |
| 211 | G → C | Yes |
| 214 | G → | No |
| 289 | C → | No |
| 390 | G → C | Yes |
| 585 | G → A | Yes |
| 651 | C → T | Yes |
| 762 | C → A | Yes |
| 789 | C → A | Yes |
| 896 | C → T | Yes |
| 1024 | G → A | Yes |
| 1030 | C → | No |
| 1030 | C → T | No |
| 1066 | T → C | Yes |
| 1111 | G → C | Yes |
| 1177 | A → G | Yes |
| 1232 | G → | No |
| 1443 | A → C | No |
| 1725 | A → | No |
| 1725 | A → T | No |
| 1852 | C → T | Yes |
| 1861 | G → A | Yes |

TABLE 428-continued

Nucleic acid SNPs

| SNP position on nucleotide sequence | Alternative nucleic acid | Previously known SNP? |
|---|---|---|
| 1862 | C → | No |
| 1967 | G → | No |
| 1967 | G → C | No |
| 1968 | C → | No |
| 1968 | C → G | No |
| 1999 | G → | No |
| 2030 | A → | No |
| 2030 | A → C | No |
| 2066 | C → T | No |
| 2121 | C → T | No |

Variant protein HSTGFB1_PEA_1_P10 (SEQ ID NO:1047) according to the present invention is encoded by transcript(s) HSTGFB1_PEA_1_T14. An alignment is given to the known protein (Transforming growth factor beta 1 precursor) in FIG. 259. One or more alignments to one or more previously published protein sequences are given in FIGS. 255-259. A brief description of the relationship of the variant protein according to the present invention to each such aligned protein is as follows:

Comparison Report Between HSTGFB1_PEA_1_P10 and TGF1_HUMAN

1. An isolated chimeric polypeptide HSTGFB1_PEA_1_P10, comprising a first amino acid sequence being at least 90% homologous to MPPSGLRLLLLLLPLLWLLVLT-PGRPAAGLSTCKTIDMELVKRKRIEAIRGQIL SKLR-LASPPSQGEVPPGPLPEAVLALYN-STRDRVAGESAEPEPEPEADYYAKE VTRVLMVETHNEIYDKFKQSTHSIYM-FFNTSELREAVPEPVLLSRAELRLLRL KLKVEQHVE-LYQKYSNNSWRYLSNRLLAPSDSPEWLS-FDVTGVVRQWLSRG GEIEGFRLSAHCSCDSRDNTLQVDIN corresponding to amino acids 1-237 of TGF1_HUMAN, which also corresponds to amino acids 1-237 of HSTGFB1_PEA_1_P10, a second amino acid sequence being at least 70%, optionally at least 80%, preferably at least 85%, more preferably at least 90% and most preferably at least 95% homologous to a polypeptide having the sequence APRRRTAACGSCTLT-SARTSAGSGSTSPRATMPTSASGPAPTF-GAWTRSTARY VWPTGLRDALGGSQDG-GRGERKRSKVREVLA corresponding to amino acids 238-321 of HSTGFB1_PEA_1_P10, and a third amino acid sequence being at least 90% homologous to LYNQHNP-GASAAPCCVPQALEPLPIVYYVGRKP-KVEQLSNMIVRSCKCS corresponding to amino acids 342-390 of TGF1_HUMAN, which also corresponds to amino acids 322-370 of HSTGFB1_PEA_1_P10, wherein said first amino acid sequence, second amino acid sequence and third amino acid sequence are contiguous and in a sequential order.

2. An isolated chimeric polypeptide for an edge portion of HSTGFB1_PEA_1_P10, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NA, having a structure as follows: a sequence starting from any of amino acid numbers 237-x to 238; and ending at any of amino acid numbers 238+((n-2)-x), in which x varies from 0 to n-2.

3. An isolated polypeptide for an edge portion of HSTGFB1_PEA_1_P10, comprising an amino acid sequence being at least 70%, optionally at least about 80%, preferably at least about 85%, more preferably at least about 90% and most preferably at least about 95% homologous to the sequence encoding for APRRRTAACGSCTLTSART-SAGSGSTSPRATMPTSASGPAPTFGAWTRSTARY VWPTGLRDALGGSQDGGRGERKRSKVREVLA, corresponding to HSTGFB1_PEA_1_P10.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSTGFB1_PEA_1_P10 also has the following non-silent SNPs (Single Nucleotide Polymorphisms) as listed in Table 429, (given according to their position(s) on the amino acid sequence, with the alternative amino acid(s) listed; the last column indicates whether the SNP is known or not; the presence of known SNPs in variant protein HSTGFB1_PEA_1_P10 sequence provides support for the deduced sequence of this variant protein according to the present invention).

TABLE 429

Amino acid mutations

| SNP position(s) on amino acid sequence | Alternative amino acid(s) | Previously known SNP? |
|---|---|---|
| 10 | L → P | Yes |
| 25 | R → P | Yes |
| 47 | E → G | Yes |
| 65 | Q → | No |
| 136 | N → H | No |
| 230 | N → Y | No |
| 230 | N → | No |
| 272 | S → F | Yes |
| 275 | G → D | Yes |
| 275 | G → | No |
| 340 | A → | No |
| 340 | A → G | No |
| 340 | A → P | No |
| 350 | V → | No |
| 361 | N → | No |
| 361 | N → H | No |

The variant protein has the following domains, as determined by using InterPro. The domains are described in Table 430:

TABLE 430

InterPro domain(s)

| InterPro ID | Domain description | Analysis type | Position(s) on protein |
|---|---|---|---|
| IPR003911 | Transforming growth factor beta TGFb | FPrintScan | 163-177, 17-36, 178-193, 195-209, 72-84 |
| IPR003939 | Transforming growth factor, beta 1 | FPrintScan | 12-31, 135-154, 166-177, 207-219, 34-43 |
| IPR001839 | Transforming growth factor beta | HMMPfam | 319-370 |
| IPR001111 | Transforming growth factor beta (TGFb), N-terminal | HMMPfam | 33-236 |
| IPR001839 | Transforming growth factor beta | HMMSmart | 311-370 |
| IPR001839 | Transforming growth factor beta | BlastProDom | 318-370 |
| IPR001839 | Transforming growth factor beta | ProfileScan | 319-370 |

Variant protein HSTGFB1_PEA_1_P10 is encoded by the following transcript(s): HSTGFB1_PEA_1_T14. The coding portion of transcript HSTGFB1_PEA_1_T14 starts at position 1038 and ends at position 2147. The transcript also has the following SNPs as listed in Table 431 (given according to their position on the nucleotide sequence, with the alternative nucleic acid listed; the last column indicates whether the SNP is known or not; the presence of known SNPs in variant protein HSTGFB1_PEA_1_P10 sequence provides support for the deduced sequence of this variant protein according to the present invention).

TABLE 431

Nucleic acid SNPs

| SNP position on nucleotide sequence | Alternative nucleic acid | Previously known SNP? |
|---|---|---|
| 181 | C → A | Yes |
| 205 | C → T | Yes |
| 206 | T → A | Yes |
| 211 | G → C | Yes |
| 214 | G → | No |
| 289 | C → | No |
| 390 | G → C | Yes |
| 585 | G → A | Yes |
| 651 | C → T | Yes |
| 762 | C → A | Yes |
| 789 | C → A | Yes |
| 896 | C → T | Yes |
| 1024 | G → A | Yes |
| 1030 | C → | No |
| 1030 | C → T | No |
| 1066 | T → C | Yes |
| 1111 | G → C | Yes |
| 1177 | A → G | Yes |
| 1232 | G → | No |
| 1443 | A → C | No |
| 1725 | A → | No |
| 1725 | A → T | No |
| 1852 | C → T | Yes |
| 1861 | G → A | Yes |
| 1862 | C → | No |
| 2055 | G → | No |
| 2055 | G → C | No |
| 2056 | C → | No |
| 2056 | C → G | No |
| 2087 | G → | No |
| 2118 | A → | No |
| 2118 | A → C | No |

TABLE 431-continued

Nucleic acid SNPs

| SNP position on nucleotide sequence | Alternative nucleic acid | Previously known SNP? |
|---|---|---|
| 2154 | C → T | No |
| 2209 | C → T | No |

FIG. 254 depicts the domain structure of the variants described hereinabove in comparison to the known or wild-type (WT) TGF-beta protein.

Example 66

Description for Cluster HUMUPAA

Cluster HUMUPAA features 3 transcript(s) and 50 segment(s) of interest, the names for which are given in Tables 432 and 433, respectively. The selected protein variants are given in Table 434.

TABLE 432

Transcripts of interest

| Transcript Name | SEQ ID NO: |
|---|---|
| HUMUPAA_T17 | 1049 |
| HUMUPAA_T24 | 1050 |
| HUMUPAA_T27 | 1051 |

TABLE 433

Segments of interest

| Segment Name | SEQ ID NO: |
|---|---|
| HUMUPAA_node_0 | 1052 |
| HUMUPAA_node_73 | 1053 |
| HUMUPAA_node_82 | 1054 |
| HUMUPAA_node_84 | 1055 |

TABLE 433-continued

Segments of interest

| Segment Name | SEQ ID NO: |
|---|---|
| HUMUPAA_node_85 | 1056 |
| HUMUPAA_node_1 | 1057 |
| HUMUPAA_node_5 | 1058 |
| HUMUPAA_node_10 | 1059 |
| HUMUPAA_node_11 | 1060 |
| HUMUPAA_node_12 | 1061 |
| HUMUPAA_node_15 | 1062 |
| HUMUPAA_node_16 | 1063 |
| HUMUPAA_node_17 | 1064 |
| HUMUPAA_node_18 | 1065 |
| HUMUPAA_node_22 | 1066 |
| HUMUPAA_node_23 | 1067 |
| HUMUPAA_node_24 | 1068 |
| HUMUPAA_node_25 | 1069 |
| HUMUPAA_node_29 | 1070 |
| HUMUPAA_node_30 | 1071 |
| HUMUPAA_node_31 | 1072 |
| HUMUPAA_node_32 | 1073 |
| HUMUPAA_node_33 | 1074 |
| HUMUPAA_node_36 | 1075 |
| HUMUPAA_node_39 | 1076 |
| HUMUPAA_node_40 | 1077 |
| HUMUPAA_node_41 | 1078 |
| HUMUPAA_node_42 | 1079 |
| HUMUPAA_node_43 | 1080 |
| HUMUPAA_node_44 | 1081 |
| HUMUPAA_node_45 | 1082 |
| HUMUPAA_node_46 | 1083 |
| HUMUPAA_node_47 | 1084 |
| HUMUPAA_node_55 | 1085 |
| HUMUPAA_node_56 | 1086 |
| HUMUPAA_node_57 | 1087 |
| HUMUPAA_node_59 | 1088 |
| HUMUPAA_node_60 | 1089 |
| HUMUPAA_node_61 | 1090 |
| HUMUPAA_node_62 | 1091 |
| HUMUPAA_node_63 | 1092 |
| HUMUPAA_node_65 | 1093 |
| HUMUPAA_node_66 | 1094 |
| HUMUPAA_node_68 | 1095 |
| HUMUPAA_node_69 | 1096 |
| HUMUPAA_node_70 | 1097 |
| HUMUPAA_node_79 | 1098 |
| HUMUPAA_node_80 | 1099 |
| HUMUPAA_node_81 | 1100 |
| HUMUPAA_node_83 | 1101 |

TABLE 434

Proteins of interest

| Protein Name | SEQ ID NO: | Protein Length | Corresponding Transcript(s) |
|---|---|---|---|
| HUMUPAA_P14 | 1102 | P482 | HUMUPAA_T17 |
| HUMUPAA_P17 | 1103 | P433 | HUMUPAA_T24 |
| HUMUPAA_P20 | 1104 | P370 | HUMUPAA_T27 |

These sequences are variants of the known protein Tissue-type plasminogen activator precursor (SwissProt accession identifier TPA_HUMAN; SEQ ID NO:150; known also according to the synonyms EC 3.4.21.68; tPA; t-PA; t-plasminogen activator; Alteplase; Reteplase), referred to herein as the previously known protein.

Protein Tissue-type plasminogen activator precursor is known or believed to have the following function(s): Converts the abundant, but inactive, zymogen plasminogen to plasmin by hydrolyzing a single Arg-Val bond in plasminogen. By controlling plasmin-mediated proteolysis, it plays an important role in tissue remodeling and degradation, in cell migration and many other physiopathological events. The sequence for protein Tissue-type plasminogen activator precursor is set forth by SEQ ID NO:150, as "Tissue-type plasminogen activator precursor amino acid sequence". Known polymorphisms for this sequence are as shown in Table 435.

TABLE 435

Amino acid mutations for Known Protein

| SNP position(s) on amino acid sequence | Comment |
|---|---|
| 164 | R → W (in dbSNP: 2020921)./FTId = VAR_011783. |
| 93 | N → T |
| 159-160 | KP → NA |

Protein Tissue-type plasminogen activator precursor localization is believed to be Secreted; extracellular.

The previously known protein also has the following indication(s) and/or potential therapeutic use(s): Infarction, myocardial; Ischaemia, cerebral; Thrombosis, pulmonary; Thrombosis, cerebral; Thrombosis. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein or of drugs directed against this protein are as follows: Fibrinogen antagonist; Plasminogen activator stimulant; Thrombin inhibitor. A therapeutic role for a protein represented by the cluster has been predicted. The cluster was assigned this field because there was information in the drug database or the public databases (e.g., described herein above) that this protein, or part thereof, is used or can be used for a potential therapeutic indication: Fibrinolytic; Cardiovascular; Neuroprotective; Respiratory.

The following GO Annotation(s) apply to the previously known protein. The following annotation(s) were found: protein modification; proteolysis and peptidolysis; blood coagulation, which are annotation(s) related to Biological Process; chymotrypsin; trypsin; T-plasminogen activator; hydrolase, which are annotation(s) related to Molecular Function; and extracellular, which are annotation(s) related to Cellular Component.

The GO assignment relies on information from one or more of the SwissProt/TremB1 Protein knowledgebase, or Locuslink.

Tissue-type plasminogen activator precursor (t-PA) is a serine protease responsible for converting the inactive, zymogen plasminogen to plasmin by specific cleavage of Arg-|-Val bond. It plays an important role in fibrinolysis, tissue remodeling and degradation and cell migration. It is a heterodimer of chain A and chain B held by a disulfide bond. It binds to fibrin with high affinity. This interaction leads to an increase in the catalytic efficiency of the enzyme between 100- and 1000-fold, due to an increase in affinity for plasminogen. It binds to mannose receptor and the low-density lipoprotein receptor-related protein (LRP1). These proteins are involved in TPA clearance. Unidentified interactions on endothelial cells and vascular smooth muscle cells (VSMC) lead to a 100-fold stimulation of plasminogen activation.

Tissue-type plasminogen activator precursor (t-PA) is related to the following diseases; for example, increased activity of TPA causes hyperfibrinolysis, with excessive bleeding as a consequence. Defective release of TPA causes hypofibrinolysis, leading to thrombosis or embolism. Pharmaceutical uses include but are not limited to Acute Myocardial Infarction (AMI), Acute Ischemic Stroke (AIS) and Pulmonary Embolism (PE) to initiates fibrinolysis (see for example Activase (Genentech) and Retavase (Centocor and Roche)).

As noted above, cluster HUMUPAA features 3 transcript(s), which were listed in Table 1 above. These transcript(s) encode for protein(s) which are variant(s) of protein Tissue-type plasminogen activator precursor. A description of each variant protein according to the present invention is now provided.

Variant protein HUMUPAA_P14 (SEQ ID NO:1102) according to the present invention is encoded by transcript(s) HUMUPAA_T17. An alignment is given to the known protein (Tissue-type plasminogen activator precursor) in FIG. 260. One or more alignments to one or more previously published protein sequences are given in FIGS. 260-262. A brief description of the relationship of the variant protein according to the present invention to each such aligned protein is as follows:

Comparison Report Between HUMUPAA_P14 and TPA_HUMAN:

1. An isolated chimeric polypeptide HUMUPAA_P14, comprising a first amino acid sequence being at least 90% homologous to MDAMKRGLCCVLLLCGAVFVSPSQEIHARFRRGARSYQVICRDEKTQMIYQQ H corresponding to amino acids 1-53 of TPA_HUMAN, which also corresponds to amino acids 1-53 of HUMUPAA_P14, a second amino acid sequence bridging amino acid sequence comprising of H, and a third amino acid sequence being at least 90% homologous to YRGTWSTAESGAECTNWNSSALAQKPYSGRRPDAIRLGLGNHNYCRNPDRD SKPWCYVFKAGKYSSEFCSTPACSEGNSDCYFGNGSAYRGTHSLTESGASCLP WNSMILIGKVYTAQNPSAQALGLGKHNYCRNPDGDAKPWCHVLKNRRLTW EYCDVPSCSTCGLRQYSQPQERIKGGLFADIASHPWQAAIFAKHRRSPGERFL CGGILISSCWILSAAHCFQERFPPHHLTVILGRTYRVVPGEEEQKFEVEKYIVH KEFDDDTYDNDIALLQLKSDSSRCAQESSVVRTVCLPPADLQLPDWTECELSG YGKHEALSPFYSERLKEAHVRLYPSSRCTSQHLLNRTVTDNMLCAGDTRSGG PQANLHDACQGDSGGPLVCLNDGRMTLVGIISWGLGCGQKDVPGVYTKVTN YLDWIRDNMRP corresponding to amino acids 135-562 of TPA_HUMAN, which also corresponds to amino acids 55-482 of HUMUPAA_P14, wherein said first amino acid sequence, second amino acid sequence and third amino acid sequence are contiguous and in a sequential order.

2. An isolated polypeptide for an edge portion of HUMUPAA_P14, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise HHY having a structure as follows (numbering according to HUMUPAA_P14): a sequence starting from any of amino acid numbers 53-x to 53; and ending at any of amino acid numbers 55+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMUPAA_P14 also has the following non-silent SNPs (Single Nucleotide Polymorphisms) as listed in Table 436, (given according to their position(s) on the amino acid sequence, with the alternative amino acid(s) listed; the last column indicates whether the SNP is known or not; the presence of known SNPs in variant protein HUMUPAA_P14 sequence provides support for the deduced sequence of this variant protein according to the present invention).

TABLE 436

Amino acid mutations

| SNP position(s) on amino acid sequence | Alternative amino acid(s) | Previously known SNP? |
|---|---|---|
| 66 | A → T | Yes |
| 76 | L → | No |

TABLE 436-continued

Amino acid mutations

| SNP position(s) on amino acid sequence | Alternative amino acid(s) | Previously known SNP? |
|---|---|---|
| 84 | R → W | Yes |
| 90 | R → G | No |
| 108 | P → | No |
| 108 | P → A | No |
| 125 | T → | No |
| 141 | S → L | No |
| 154 | A → V | No |
| 156 | C → S | No |
| 179 | L → | No |
| 196 | P → | No |
| 198 | C → | No |
| 198 | C → W | No |
| 203 | N → D | No |
| 214 | P → | No |
| 214 | P → A | No |
| 217 | S → | No |
| 254 | R → | No |
| 263 | G → | No |
| 265 | I → V | No |
| 299 | V → | No |
| 378 | F → L | No |
| 389 | R → T | No |
| 420 | G → | No |
| 435 | G → | No |
| 481 | R → * | Yes |

The glycosylation sites of variant protein HUMUPAA_P14, as compared to the known protein Tissue-type plasminogen activator precursor, are described in Table 437 (given according to their position(s) on the amino acid sequence in the first column; the second column indicates whether the glycosylation site is present in the variant protein; and the last column indicates whether the position is different on the variant protein).

TABLE 437

Glycosylation site(s)

| Position(s) on known amino acid sequence | Present in variant protein? | Position in variant protein? |
|---|---|---|
| 483 | yes | 403 |
| 96 | no | |
| 152 | yes | 72 |
| 219 | yes | 139 |

The variant protein has the following domains, as determined by using InterPro. The domains are described in Table 438:

TABLE 438

InterPro domain(s)

| InterPro ID | Domain description | Analysis type | Position(s) on protein |
|---|---|---|---|
| IPR000001 | Kringle | FPrintScan | 135-150, 151-163, 180-200, 205-216 |
| IPR001314 | Peptidase S1A, chymotrypsin | FPrintScan | 263-278, 322-336, 426-438 |
| IPR000001 | Kringle | HMMPfam | 135-216, 55-128 |
| IPR001254 | Peptidase S1, chymotrypsin | HMMPfam | 231-476 |
| IPR001254 | Peptidase S1, chymotrypsin | HMMSmart | 230-476 |
| IPR000001 | Kringle | HMMSmart | 133-218, 47-130 |
| IPR000001 | Kringle | ScanRegExp | 186-198, 98-110 |
| IPR001254 | Peptidase S1, chymotrypsin | ScanRegExp | 273-278 |
| IPR001254 | Peptidase S1, chymotrypsin | ScanRegExp | 427-438 |
| IPR000001 | Kringle | BlastProDom | 134-197, 55-109 |
| IPR000001 | Kringle | ProfileScan | 134-216, 55-128 |
| IPR001254 | Peptidase S1, chymotrypsin | ProfileScan | 231-481 |

Variant protein HUMUPAA_P14 is encoded by the following transcript(s): HUMUPAA_T17. The coding portion of transcript HUMUPAA_T17 starts at position 236 and ends at position 1681. The transcript also has the following SNPs as listed in Table 439 (given according to their position on the nucleotide sequence, with the alternative nucleic acid listed; the last column indicates whether the SNP is known or not; the presence of known SNPs in variant protein HUMUPAA_P14 sequence provides support for the deduced sequence of this variant protein according to the present invention).

TABLE 439

Nucleic acid SNPs

| SNP position on nucleotide sequence | Alternative nucleic acid | Previously known SNP? |
|---|---|---|
| 111 | A → | No |
| 163 | G → | No |
| 431 | G → A | Yes |
| 461 | T → | No |
| 485 | C → T | Yes |
| 496 | T → C | Yes |
| 503 | A → G | No |
| 538 | C → T | Yes |
| 557 | C → | No |
| 557 | C → G | No |
| 568 | C → T | No |
| 609 | C → | No |
| 657 | C → T | No |
| 679 | C → T | Yes |
| 696 | C → T | No |
| 701 | T → A | No |
| 772 | G → | No |
| 777 | → G | No |
| 821 | C → | No |
| 829 | C → | No |
| 829 | C → G | No |
| 842 | A → G | No |
| 856 | G → A | Yes |
| 875 | C → | No |
| 875 | C → G | No |
| 884 | T → | No |
| 996 | G → | No |
| 1022 | G → | No |
| 1028 | A → G | No |
| 1057 | T → C | No |
| 1063 | C → T | No |
| 1132 | C → | No |
| 1147 | G → A | Yes |
| 1162 | C → A | Yes |
| 1162 | C → G | Yes |
| 1174 | T → C | Yes |
| 1195 | T → C | No |
| 1301 | C → T | Yes |
| 1363 | T → C | Yes |
| 1367 | T → C | No |
| 1401 | G → C | No |
| 1493 | G → | No |
| 1534 | G → A | Yes |

TABLE 439-continued

Nucleic acid SNPs

| SNP position on nucleotide sequence | Alternative nucleic acid | Previously known SNP? |
|---|---|---|
| 1540 | C → | No |
| 1676 | C → T | Yes |
| 1756 | C → G | Yes |
| 1946 | C → | No |
| 2106 | T → C | Yes |
| 2143 | C → | No |
| 2166 | T → C | Yes |
| 2229 | T → C | Yes |
| 2339 | C → A | Yes |

Variant protein HUMUPAA_P17 (SEQ ID NO:1103) according to the present invention is encoded by transcript(s) HUMUPAA_T24. An alignment is given to the known protein (Tissue-type plasminogen activator precursor) in FIG. 261. One or more alignments to one or more previously published protein sequences are given in FIGS. 260-262. A brief description of the relationship of the variant protein according to the present invention to each such aligned protein is as follows:

Comparison Report Between HUMUPAA_P17 and TPA_HUMAN:

1. An isolated chimeric polypeptide HUMUPAA_P17, comprising a first amino acid sequence being at least 90% homologous to MDAMKRGLCCV-LLLCGAVFVSPSQEIHARFR-RGARSYQVICRDEKTQMIYQQ HQSWLRPVLRSN-RVEYCWCNSGRAQCHSV corresponding to amino acids 1-81 of TPA_HUMAN, which also corresponds to amino acids 1-81 of HUMUPAA_P17, a second amino acid sequence bridging amino acid sequence comprising of R, and a third amino acid sequence being at least 90% homologous to NSDCYFGNGSAYRGTHSLTESGASCLP-WNSMILIGKVYTAQNPSAQALGLGK HNYCRNP-DGDAKPWCHVLKNRRLTWEYCDVPSC-STCGLRQYSQPQFRIKGG LFADIASHPWQAAIFAKHRRSPGER-FLCGGILISSCWILSAAHCFQERFPPHHLT VILGR-TYRVVPGEEEQKFEVEKYIVHKEFDDD-TYDNDIALLQLKSDSSRCAQE SSVVRTVCLPPADLQLPDWTECELS-GYGKHEALSPFYSERLKEAHVRLYPSSR CTSQHLLN-RTVTDNMLCAGDTRSGGPQANLHDAC-QGDSGGPLVCLNDGRM TLVGIISWGLGCGQKDVPGVYTKVT-NYLDWIRDNMRP corresponding to amino acids 212-562 of TPA_HUMAN, which also corresponds to amino acids 83-433 of HUMUPAA_P17, wherein said first amino acid sequence, second amino acid sequence and third amino acid sequence are contiguous and in a sequential order.

2. An isolated polypeptide for an edge portion of HUMUPAA_P17, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise VRN having a structure as follows (numbering according to HUMUPAA_P17): a sequence starting from any of amino acid numbers 81-x to 81; and ending at any of amino acid numbers 83+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMUPAA_P17 also has the following non-silent SNPs (Single Nucleotide Polymorphisms) as listed in Table 440, (given according to their position(s) on the amino acid sequence, with the alternative amino acid(s) listed; the last column indicates whether the SNP is known or not; the presence of known SNPs in variant protein HUMUPAA_P17 sequence provides support for the deduced sequence of this variant protein according to the present invention).

TABLE 440

Amino acid mutations

| SNP position(s) on amino acid sequence | Alternative amino acid(s) | Previously known SNP? |
|---|---|---|
| 56 | W → | No |
| 92 | S → L | No |
| 105 | A → V | No |
| 107 | C → S | No |
| 130 | L → | No |
| 147 | P → | No |
| 149 | C → | No |
| 149 | C → W | No |
| 154 | N → D | No |
| 165 | P → | No |
| 165 | P → A | No |
| 168 | S → | No |
| 205 | R → | No |
| 214 | G → | No |
| 216 | I → V | No |
| 250 | V → | No |
| 329 | F → L | No |
| 340 | R → T | No |
| 371 | G → | No |
| 386 | G → | No |
| 432 | R → * | Yes |

The glycosylation sites of variant protein HUMUPAA_P17, as compared to the known protein Tissue-type plasminogen activator precursor, are described in Table 441 (given according to their position(s) on the amino acid sequence in the first column; the second column indicates whether the glycosylation site is present in the variant protein; and the last column indicates whether the position is different on the variant protein).

TABLE 441

Glycosylation site(s)

| Position(s) on known amino acid sequence | Present in variant protein? | Position in variant protein? |
|---|---|---|
| 483 | yes | 354 |
| 96 | no | |
| 152 | no | |
| 219 | yes | 90 |

The variant protein has the following domains, as determined by using InterPro. The domains are described in Table 442:

TABLE 442

InterPro domain(s)

| InterPro ID | Domain description | Analysis type | Position(s) on protein |
|---|---|---|---|
| IPR000001 | Kringle | FPrintScan | 102-114, 131-151, 156-167, 86-101 |
| IPR001314 | Peptidase S1A, chymotrypsin | FPrintScan | 214-229, 273-287, 377-389 |
| IPR000083 | Fibronectin, type I | HMMPfam | 41-78 |
| IPR000001 | Kringle | HMMPfam | 86-167 |
| IPR001254 | Peptidase S1, chymotrypsin | HMMPfam | 182-427 |
| IPR001254 | Peptidase S1, chymotrypsin | HMMSmart | 181-427 |
| IPR000083 | Fibronectin, type I | HMMSmart | 41-83 |
| IPR000001 | Kringle | HMMSmart | 84-169 |
| IPR000001 | Kringle | ScanRegExp | 137-149 |
| IPR001254 | Peptidase S1, chymotrypsin | ScanRegExp | 224-229 |
| IPR001254 | Peptidase S1, chymotrypsin | ScanRegExp | 378-389 |
| IPR000083 | Fibronectin, type I | ScanRegExp | 41-78 |
| IPR000001 | Kringle | BlastProDom | 85-148 |
| IPR000001 | Kringle | ProfileScan | 85-167 |
| IPR001254 | Peptidase S1, chymotrypsin | ProfileScan | 182-432 |

Variant protein HUMUPAA_P17 is encoded by the following transcript(s): HUMUPAA_T24. The coding portion of transcript HUMUPAA_T24 starts at position 236 and ends at position 1534. The transcript also has the following SNPs as listed in Table 443 (given according to their position on the nucleotide sequence, with the alternative nucleic acid listed; the last column indicates whether the SNP is known or not; the presence of known SNPs in variant protein HUMUPAA_P17 sequence provides support for the deduced sequence of this variant protein according to the present invention).

TABLE 443

Nucleic acid SNPs

| SNP position on nucleotide sequence | Alternative nucleic acid | Previously known SNP? |
|---|---|---|
| 111 | A → | No |
| 163 | G → | No |
| 402 | G → | No |
| 510 | C → T | No |
| 532 | C → T | Yes |
| 549 | C → T | No |
| 554 | T → A | No |
| 625 | G → | No |
| 630 | → G | No |
| 674 | C → | No |
| 682 | C → | No |
| 682 | C → G | No |
| 695 | A → G | No |
| 709 | G → A | Yes |
| 728 | C → | No |
| 728 | C → G | No |
| 737 | T → | No |
| 849 | G → | No |
| 875 | G → | No |
| 881 | A → G | No |
| 910 | T → C | No |
| 916 | C → T | No |
| 985 | C → | No |
| 1000 | G → A | Yes |
| 1015 | C → A | Yes |
| 1015 | C → G | Yes |
| 1027 | T → C | Yes |
| 1048 | T → C | No |
| 1154 | C → T | Yes |
| 1216 | T → C | Yes |
| 1220 | T → C | No |
| 1254 | G → C | No |
| 1346 | G → | No |
| 1387 | G → A | Yes |
| 1393 | C → | No |
| 1529 | C → T | Yes |
| 1609 | C → G | Yes |
| 1799 | C → | No |
| 1959 | T → C | Yes |
| 1996 | C → | No |
| 2019 | T → C | Yes |
| 2082 | T → C | Yes |
| 2192 | C → A | Yes |

Variant protein HUMUPAA_P20 (SEQ ID NO:1104) according to the present invention is encoded by transcript(s) HUMUPAA_T27. An alignment is given to the known protein (Tissue-type plasminogen activator precursor) in FIG. 262. One or more alignments to one or more previously published protein sequences are given in FIGS. 260-262. A brief description of the relationship of the variant protein according to the present invention to each such aligned protein is as follows:

Comparison Report Between HUMUPAA_P20 and TPA_HUMAN:

1. An isolated chimeric polypeptide HUMUPAA_P20, comprising a first amino acid sequence being at least 90% homologous to MDAMKRGLCCV-LLLCGAVFVSPSQEIHARFRRGARSYQ corresponding to amino acids 1-38 of TPA_HUMAN, which also corresponds to amino acids 1-38 of HUMUPAA_P20, a second amino acid sequence bridging amino acid sequence comprising of G, a third amino acid sequence being at least 90% homologous to CSEPRCFNGGTCQQALYFSDFVC corresponding to amino acids 86-108 of TPA_HUMAN, which also corresponds to amino acids 40-62 of HUMUPAA_P20, a fourth amino acid sequence bridging amino acid sequence comprising of H, and a fifth amino acid sequence being at least 90% homologous to AQALGLGKHNYCRNP-DGDAKPWCHVLKNRRLTWEYCDVPSCSTCGLRQYS QPQFRIKGGLFADIASHPWQAAIFA-KHRRSPGERFLCGGILISSCWILSAAHCF QERFP-PHHLTVILGRTYRVVPGEEEQKFE-VEKYIVHKEFDDDTYDNDIALLQL KSDSSRCAQESSVVRTVCLPPADLQLPD-WTECELSGYGKHEALSPFYSERLKE AHVRLYPSS-RCTSQHLLNRTVTDNMLCAGDTRSGG-PQANLHDACQGDSGGP LVCLNDGRMTLVGIISWGLGCGQKD-VPGVYTKVTNYLDWIRDNMRP corresponding to amino acids 256-562 of TPA_HUMAN, which also corresponds to amino acids 64-370 of HUMUPAA_P20, wherein said first amino acid sequence, second amino acid sequence, third amino acid sequence, fourth amino acid sequence and fifth amino acid sequence are contiguous and in a sequential order.

2. An isolated polypeptide for an edge portion of HUMUPAA_P20, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QGC having a structure as follows (numbering according to HUMUPAA_P20): a sequence starting from any of amino acid numbers 38-x to 38; and ending at any of amino acid numbers 40+((n−2)−x), in which x varies from 0 to n−2.

3. An isolated polypeptide for an edge portion of HUMU-PAA_P20, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise CHA having a structure as follows (numbering according to HUMUPAA_P20): a sequence starting from any of amino acid numbers 62-x to 62; and ending at any of amino acid numbers 64+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMUPAA_P20 also has the following non-silent SNPs (Single Nucleotide Polymorphisms) as listed in Table 444, (given according to their position(s) on the amino acid sequence, with the alternative amino acid(s) listed; the last column indicates whether the SNP is known or not; the presence of known SNPs in variant protein HUMU-PAA_P20 sequence provides support for the deduced sequence of this variant protein according to the present invention).

TABLE 444

Amino acid mutations

| SNP position(s) on amino acid sequence | Alternative amino acid(s) | Previously known SNP? |
|---|---|---|
| 61 | V → M | No |
| 62 | C → R | No |
| 67 | L → | No |
| 84 | P → | No |
| 86 | C → | No |
| 86 | C → W | No |
| 91 | N → D | No |
| 102 | P → | No |
| 102 | P → A | No |
| 105 | S → | No |
| 142 | R → | No |
| 151 | G → | No |
| 153 | I → V | No |
| 187 | V → | No |
| 266 | F → L | No |
| 277 | R → T | No |
| 308 | G → | No |
| 323 | G → | No |
| 369 | R → * | Yes |

The glycosylation sites of variant protein HUMU-PAA_P20, as compared to the known protein Tissue-type plasminogen activator precursor, are described in Table 445 (given according to their position(s) on the amino acid sequence in the first column; the second column indicates whether the glycosylation site is present in the variant protein; and the last column indicates whether the position is different on the variant protein).

TABLE 445

Glycosylation site(s)

| Position(s) on known amino acid sequence | Present in variant protein? | Position in variant protein? |
|---|---|---|
| 483 | yes | 291 |
| 96 | yes | 50 |
| 152 | no | |
| 219 | no | |

The variant protein has the following domains, as determined by using InterPro. The domains are described in Table 446:

TABLE 446

InterPro domain(s)

| InterPro ID | Domain description | Analysis type | Position(s) on protein |
|---|---|---|---|
| IPR000001 | Kringle | FPrintScan | 68-88, 93-104 |
| IPR001314 | Peptidase S1A, chymotrypsin | FPrintScan | 151-166, 210-224, 314-326 |
| IPR000001 | Kringle | HMMPfam | 64-104 |
| IPR001254 | Peptidase S1, chymotrypsin | HMMPfam | 119-364 |
| IPR001254 | Peptidase S1, chymotrypsin | HMMSmart | 118-364 |
| IPR000001 | Kringle | HMMSmart | 43-106 |
| IPR000001 | Kringle | ScanRegExp | 74-86 |
| IPR001254 | Peptidase S1, chymotrypsin | ScanRegExp | 161-166 |
| IPR001254 | Peptidase S1, chymotrypsin | ScanRegExp | 315-326 |
| IPR000001 | Kringle | BlastProDom | 64-85 |
| IPR000001 | Kringle | ProfileScan | 71-104 |
| IPR001254 | Peptidase S1, chymotrypsin | ProfileScan | 119-369 |

Variant protein HUMUPAA_P20 is encoded by the following transcript(s): HUMUPAA_T27. The coding portion of transcript HUMUPAA_T27 starts at position 236 and ends at position 1345. The transcript also has the following SNPs as listed in Table 447 (given according to their position on the nucleotide sequence, with the alternative nucleic acid listed; the last column indicates whether the SNP is known or not; the presence of known SNPs in variant protein HUMU-PAA_P20 sequence provides support for the deduced sequence of this variant protein according to the present invention).

TABLE 447

Nucleic acid SNPs

| SNP position on nucleotide sequence | Alternative nucleic acid | Previously known SNP? |
|---|---|---|
| 111 | A → | No |
| 163 | G → | No |
| 416 | G → A | No |
| 419 | T → C | No |
| 436 | G → | No |
| 441 | → G | No |
| 485 | C → | No |
| 493 | C → | No |
| 493 | C → G | No |
| 506 | A → G | No |
| 520 | G → A | Yes |
| 539 | C → | No |
| 539 | C → G | No |
| 548 | T → | No |
| 660 | G → | No |

TABLE 447-continued

Nucleic acid SNPs

| SNP position on nucleotide sequence | Alternative nucleic acid | Previously known SNP? |
|---|---|---|
| 686 | G → | No |
| 692 | A → G | No |
| 721 | T → C | No |
| 727 | C → T | No |
| 796 | C → | No |
| 811 | G → A | Yes |
| 826 | C → A | Yes |
| 826 | C → G | Yes |
| 838 | T → C | Yes |
| 859 | T → C | No |
| 965 | C → T | Yes |
| 1027 | T → C | Yes |
| 1031 | T → C | No |
| 1065 | G → C | No |
| 1157 | G → | No |
| 1198 | G → A | Yes |
| 1204 | C → | No |
| 1340 | C → T | Yes |
| 1420 | C → G | Yes |
| 1610 | C → | No |
| 1770 | T → C | Yes |
| 1807 | C → | No |
| 1830 | T → C | Yes |
| 1893 | T → C | Yes |
| 2003 | C → A | Yes |

FIG. 263 depicts the domain structure of the variants described hereinabove in comparison to the known or wild-type (WT) TPA_HUMAN protein:

Example 67

Description for Cluster HUMDNASEI

Cluster HUMDNASEI features 5 transcript(s) and 17 segment(s) of interest, the names for which are given in Tables 448 and 449, respectively. The selected protein variants are given in Table 450.

TABLE 448

Transcripts of interest

| Transcript Name | SEQ ID NO: |
|---|---|
| HUMDNASEI_PEA_1_T2 | 1105 |
| HUMDNASEI_PEA_1_T5 | 1106 |
| HUMDNASEI_PEA_1_T7 | 1107 |
| HUMDNASEI_PEA_1_T12 | 1108 |
| HUMDNASEI_PEA_1_T13 | 1109 |

TABLE 449

Segments of interest

| Segment Name | SEQ ID NO: |
|---|---|
| HUMDNASEI_PEA_1_node_0 | 1110 |
| HUMDNASEI_PEA_1_node_1 | 1111 |
| HUMDNASEI_PEA_1_node_4 | 1112 |
| HUMDNASEI_PEA_1_node_6 | 1113 |

TABLE 449-continued

Segments of interest

| Segment Name | SEQ ID NO: |
|---|---|
| HUMDNASEI_PEA_1_node_26 | 1114 |
| HUMDNASEL_PEA_1_node_2 | 1115 |
| HUMDNASEI_PEA_1_node_3 | 1116 |
| HUMDNASEI_PEA_1_node_8 | 1117 |
| HUMDNASEI_PEA_1_node_12 | 1118 |
| HUMDNASEI_PEA_1_node_14 | 1119 |
| HUMDNASEI_PEA_1_node_17 | 1120 |
| HUMDNASEI_PEA_1_node_19 | 1121 |
| HUMDNASEI_PEA_1_node_20 | 1122 |
| HUMDNASET_PEA_1_node_21 | 1123 |
| HUMDNASEI_PEA_1_node_23 | 1124 |
| HUMDNASEI_PEA_1_node_24 | 1125 |
| HUMDNASEI_PEA_1_node_25 | 1126 |

TABLE 450

Proteins of interest

| Protein Name | SEQ ID NO: | Protein Length | Corresponding Transcript(s) |
|---|---|---|---|
| HUMDNASE1_PEA_1_P3 | 1127 | P213 | HUMDNASEI_PEA_1_T2 |
| HUMDNASE1_PEA_1_P4 | 1128 | P276 | HUMDNASEI_PEA_1_T5; HUMDNASEI_PEA_1_T12 |
| HUMDNASE1_PEA_1_P6 | 1129 | P239 | HUMDNASEI_PEA_1_T7 |
| HUMDNASEI_PEA_1_P1 | 1130 | P157 | HUMDNASEI_PEA_1_T13 |

These sequences are variants of the known protein Deoxyribonuclease I precursor (SwissProt accession identifier DRN1_HUMAN; SEQ ID NO:1131; known also according to the synonyms EC 3.1.21.1; DNase I; Dornase alfa), referred to herein as the previously known protein.

Protein Deoxyribonuclease I precursor is known or believed to have the following function(s): Among other functions, seems to be involved in cell death by apoptosis. Binds specifically to G-actin and blocks actin polymerization (By similarity). The sequence for protein Deoxyribonuclease I precursor is set forth by SEQ ID NO:1131, as "Deoxyribonuclease I precursor amino acid sequence". Known polymorphisms for this sequence are as shown in Table 451.

TABLE 451

Amino acid mutations for Known Protein

| SNP position(s) on amino acid sequence | Comment |
|---|---|
| 31 | Q → E (in allele DNASE1*4)./FTId = VAR_002264. |
| 114 | V → M (in allele DNASE1*5)./FTId = VAR_009300. |

TABLE 451-continued

Amino acid mutations for Known Protein

SNP position(s) on
amino acid sequence | Comment
---|---
154 | P → A (in allele DNASE1*3; dbSNP: 1799891)./FTId = VAR_002265.
207 | R → C (in allele DNASE1*6)./FTId = VAR_009301.
244 | R → Q (in allele DNASE1*1; dbSNP: 1053874)./FTId = VAR_002266.
16 | L → H Protein Deoxyribonuclease I precursor localization is believed to be Secretory protein, stored in zymogen granules and found in the nuclear envelope.

The previously known protein also has the following indication(s) and/or potential therapeutic use(s): Cystic fibrosis; Cancer, general. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Deoxyribonuclease 1 stimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Cystic fibrosis treatment; Cancer, general.

The following GO Annotation(s) apply to the previously known protein. The following annotation(s) were found: extracellular, which are annotation(s) related to Cellular Component.

The GO assignment relies on information from one or more of the SwissProt/TremB1 Protein knowledgebase, or Locuslink.

As noted above, cluster HUMDNASEI features 5 transcript(s), which were listed in Table 1 above. These transcript(s) encode for protein(s) which are variant(s) of protein Deoxyribonuclease I precursor. A description of each variant protein according to the present invention is now provided.

Variant protein HUMDNASEI_PEA_1_P3 (SEQ ID NO:1127) according to the present invention is encoded by transcript(s) HUMDNASEI_PEA_1_T2. An alignment is given to the known protein (Deoxyribonuclease I precursor) in FIG. 264. One or more alignments to one or more previously published protein sequences are given in FIGS. 264-268. A brief description of the relationship of the variant protein according to the present invention to each such aligned protein is as follows:

Comparison Report Between HUMDNASEI_PEA_1_P3 and DRN1_HUMAN:

1. An isolated chimeric polypeptide HUMDNASEI_PEA_1_P3, comprising a first amino acid sequence being at least 70%, optionally at least 80%, preferably at least 85%, more preferably at least 90% and most preferably at least 95% homologous to a polypeptide having the sequence MPPSSATLCR corresponding to amino acids 1-10 of HUMDNASEI_PEA_1_P3, and a second amino acid sequence being at least 90% homologous to DAPDTYHYVVSEPLGRNSYKERYLFVYRPDQVSAVDSYYYDDGCEPCGNDT ENREPAIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDR IVVAGMLLRGAVVPDSALPFNFQAAYGLSDQLAQAISDHYPVEVMLK corresponding to amino acids 80-282 of DRN1_HUMAN, which also corresponds to amino acids 11-213 of HUMDNASEI_PEA_1_P3, wherein said first amino acid sequence and second amino acid sequence are contiguous and in a sequential order.

2. An isolated polypeptide for a head of HUMDNASEI_PEA_1_P3, comprising a polypeptide being at least 70%, optionally at least about 80%, preferably at least about 85%, more preferably at least about 90% and most preferably at least about 95% homologous to the sequence MPPSSATLCR of HUMDNASEI_PEA_1_P3.

The location of the variant protein was determined according to results from a number of different software programs and analyses, including analyses from SignalP and other specialized programs. The variant protein is believed to be located as follows with regard to the cell: intracellularly. The protein localization is believed to be intracellularly because of manual inspection of known protein localization and/or gene structure.

Variant protein HUMDNASEI_PEA_1_P3 also has the following non-silent SNPs (Single Nucleotide Polymorphisms) as listed in Table 452, (given according to their position(s) on the amino acid sequence, with the alternative amino acid(s) listed; the last column indicates whether the SNP is known or not; the presence of known SNPs in variant protein HUMDNASEI_PEA_1_P3 sequence provides support for the deduced sequence of this variant protein according to the present invention).

TABLE 452

Amino acid mutations

SNP position(s) on amino acid sequence | Alternative amino acid(s) | Previously known SNP?
---|---|---
38 | R → G | Yes
48 | Y → S | No
58 | G → R | Yes
85 | P → A | Yes
162 | C → Y | Yes
175 | R → Q | Yes
177 | A → P | Yes
193 | G → D | Yes
202 | I → N | No The glycosylation sites of variant protein HUMDNASEI_PEA_1_P3, as compared to the known protein Deoxyribonuclease I precursor, are described in Table 453 (given according to their position(s) on the amino acid sequence in the first column; the second column indicates whether the glycosylation site is present in the variant protein; and the last column indicates whether the position is different on the variant protein).

TABLE 453

Glycosylation site(s)

Position(s) on known amino acid sequence | Present in variant protein? | Position in variant protein?
---|---|---
128 | yes | 59
40 | no |

The variant protein has the following domains, as determined by using InterPro. The domains are described in Table 454:

TABLE 454

InterPro domain(s)

| InterPro ID | Domain description | Analysis type | Position(s) on protein |
|---|---|---|---|
| IPR008185 | Deoxyribonuclease I | FPrintScan | 108-137, 138-167, 167-189, 190-210, 33-62, 78-107 |
| IPR005135 | Endonuclease/ exonuclease/ phosphatase | HMMPfam | 6-212 |
| IPR008185 | Deoxyribonuclease I | HMMSmart | 1-213 |
| IPR008185 | Deoxyribonuclease I | ScanRegExp | 120-127 |
| IPR008185 | Deoxyribonuclease I | ScanRegExp | 83-103 |

Variant protein HUMDNASEI_PEA_1_P3 is encoded by the following transcript(s): HUMDNASEI_PEA_1_T2. The coding portion of transcript HUMDNASEI_PEA_1_T2 starts at position 1181 and ends at position 1819. The transcript also has the following SNPs as listed in Table 455 (given according to their position on the nucleotide sequence, with the alternative nucleic acid listed; the last column indicates whether the SNP is known or not; the presence of known SNPs in variant protein HUMDNASEI_PEA_1_P3 sequence provides support for the deduced sequence of this variant protein according to the present invention).

TABLE 455

Nucleic acid SNPs

| SNP position on nucleotide sequence | Alternative nucleic acid | Previously known SNP? |
|---|---|---|
| 487 | A → C | No |
| 917 | G → | No |
| 1031 | G → A | Yes |
| 1068 | G → T | Yes |
| 1106 | C → | No |
| 1116 | G → | No |
| 1158 | A → C | Yes |
| 1240 | C → G | Yes |
| 1292 | A → G | Yes |
| 1323 | A → C | No |
| 1352 | G → A | Yes |
| 1433 | C → G | Yes |
| 1501 | C → G | Yes |
| 1540 | C → T | Yes |
| 1597 | G → A | Yes |
| 1665 | G → A | Yes |
| 1704 | G → A | Yes |
| 1709 | G → C | Yes |
| 1758 | G → A | Yes |
| 1785 | T → A | No |
| 1827 | C → A | No |
| 1828 | C → A | No |
| 1839 | C → G | Yes |

Variant protein HUMDNASEI_PEA_1_P4 (SEQ ID NO:1128) according to the present invention is encoded by transcript(s) HUMDNASEI_PEA_1_T5. An alignment is given to the known protein (Deoxyribonuclease I precursor) in FIG. 265. One or more alignments to one or more previously published protein sequences are given in FIGS. 264-268. A brief description of the relationship of the variant protein according to the present invention to each such aligned protein is as follows:

Comparison Report Between HUMDNASEI_PEA_1_P4 and DRN1_HUMAN:

1. An isolated chimeric polypeptide HUMDNASEI_PEA_1_P4, comprising a first amino acid sequence being at least 90% homologous to MRGMKLLGALLALAALLQ-GAVSLKIAAFNIQTFGETKMSNATLVSYIVQILSR YDI-ALVQEVRDSHLTAVGKLLDNLNQDAPD-TYHYVVSEPLGRNSYKERYLF VYRPDQVSAVDSYYYDDGCEPCGNDTFN-REPAIVRFFSRFTEVREFAIVPLHA APGDAVAEIDALY-DVYLDVQEKWGLEDVMLMGDFNAGC-SYVRPSQWSSIRL WTSPTFQWLIPDSADTTATPTHCAY-DRIVVAGMLLRGAVVPDSALPFNFQAA YGLSDQL corresponding to amino acids 1-267 of DRN1_HUMAN, which also corresponds to amino acids 1-267 of HUMD-NASEI_PEA_1_P4, and a second amino acid sequence being at least 70%, optionally at least 80%, preferably at least 85%, more preferably at least 90% and most preferably at least 95% homologous to a polypeptide having the sequence VCVLPCTAT corresponding to amino acids 268-276 of HUMDNASEI_PEA_1_P4, wherein said first amino acid sequence and second amino acid sequence are contiguous and in a sequential order.

2. An isolated polypeptide for a tail of HUMDNASEI_PEA_1_P4, comprising a polypeptide being at least 70%, optionally at least about 80%, preferably at least about 85%, more preferably at least about 90% and most preferably at least about 95% homologous to the sequence VCVLPCTAT in HUMDNASEI_PEA_1_P4. The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

The glycosylation sites of variant protein HUMDNASEI_PEA_1_P4, as compared to the known protein Deoxyribonuclease I precursor, are described in Table 456 (given according to their position(s) on the amino acid sequence in the first column; the second column indicates whether the glycosylation site is present in the variant protein; and the last column indicates whether the position is different on the variant protein).

TABLE 456

Glycosylation site(s)

| Position(s) on known amino acid sequence | Present in variant protein? | Position in variant protein? |
|---|---|---|
| 128 | yes | 128 |
| 40 | yes | 40 |

The variant protein has the following domains, as determined by using InterPro. The domains are described in Table 457:

TABLE 457

InterPro domain(s)

| InterPro ID | Domain description | Analysis type | Position(s) on protein |
|---|---|---|---|
| IPR008185 | Deoxyribonuclease I | FPrintScan | 102-131, 147-176, 177-206, 207-236, 236-258, 259-276, 33-62, 63-92 |
| IPR005135 | Endonuclease/ exonuclease/ phosphatase | HMMPfam | 23-271 |
| IPR008185 | Deoxyribonuclease I | HMMSmart | 6-268 |

TABLE 457-continued

| | InterPro domain(s) | | |
|---|---|---|---|
| InterPro ID | Domain description | Analysis type | Position(s) on protein |
| IPR008185 | Deoxyribonuclease I | ScanRegExp | 189-196 |
| IPR008185 | Deoxyribonuclease I | ScanRegExp | 152-172 |
| IPR008185 | Deoxyribonuclease I | FPrintScan | 102-131, 147-176, 177-206, 207-236, 236-258, 259-276, 33-62, 63-92 |
| IPR005135 | Endonuclease/ exonuclease/ phosphatase | HMMPfam | 23-271 |
| IPR008185 | Deoxyribonuclease I | HMMSmart | 6-268 |
| IPR008185 | Deoxyribonuclease I | ScanRegExp | 189-196 |
| IPR008185 | Deoxyribonuclease I | ScanRegExp | 152-172 |

Variant protein HUMDNASEI_PEA_1_P4 is encoded by the following transcript(s): HUMDNASEI_PEA_1_T5. The coding portion of transcript HUMDNASEI_PEA_1_T5 starts at position 1063 and ends at position 1890. The transcript also has the following SNPs as listed in Table 458 (given according to their position on the nucleotide sequence, with the alternative nucleic acid listed; the last column indicates whether the SNP is known or not; the presence of known SNPs in variant protein HUMDNASEI_PEA_1_P4 sequence provides support for the deduced sequence of this variant protein according to the present invention).

TABLE 458

| Nucleic acid SNPs | | |
|---|---|---|
| SNP position on nucleotide sequence | Alternative nucleic acid | Previously known SNP? |
| 487 | A → C | No |
| 917 | G → | No |
| 1031 | G → A | Yes |
| 1068 | G → T | Yes |
| 1106 | C → | No |
| 1116 | G → | No |
| 1158 | A → C | Yes |
| 1329 | C → G | Yes |
| 1381 | A → G | Yes |
| 1412 | A → C | No |
| 1441 | G → A | Yes |
| 1522 | C → G | Yes |
| 1590 | C → G | Yes |
| 1629 | C → T | Yes |
| 1686 | G → A | Yes |
| 1754 | G → A | Yes |
| 1793 | G → A | Yes |
| 1798 | G → C | Yes |
| 1847 | G → A | Yes |
| 1877 | C → G | Yes |
| 1894 | G → A | Yes |
| 1896 | A → G | Yes |
| 1938 | C → T | Yes |
| 1963 | T → A | No |
| 2005 | C → A | No |
| 2006 | C → A | No |
| 2017 | C → G | Yes |

Variant protein HUMDNASEI_PEA_1_P6 (SEQ ID NO:1129) according to the present invention is encoded by transcript(s) HUMDNASEI_PEA_1_T7. An alignment is given to the known protein (Deoxyribonuclease I precursor) in FIG. 266. One or more alignments to one or more previously published protein sequences are given in FIGS. 264-268. A brief description of the relationship of the variant protein according to the present invention to each such aligned protein is as follows:

Comparison Report Between HUMDNASEI_PEA_1_P6 and DRN1_HUMAN:

1. An isolated chimeric polypeptide HUMDNASEI_PEA_1_P6, comprising a first amino acid sequence being at least 90% homologous to MRGMKLLGALLALAALLQ-GAVSLKIAAFNIQTFGETKMSNATLVSYIVQILSR YDI-ALVQEVRDSHLTAVGKLLDNLNQDAPD-TYHYVVSEPLGRNSYKERYLF VYRPDQVSAVDSYYYDDGCEPCGNDTFN-REPAIVRFFSRFTEVREFAIVPLHA APGDAVAEIDALY-DVYLDVQEKWGLEDVMLMGDFNAGC-SYVRPSQWSSIRL WTSPTFQWLIPDSADTTATPTHCAYDR corresponding to amino acids 1-235 of DRN1_HUMAN, which also corresponds to amino acids 1-235 of HUMDNASEI_PEA_1_P6, and a second amino acid sequence being at least 70%, optionally at least 80%, preferably at least 85%, more preferably at least 90% and most preferably at least 95% homologous to a polypeptide having the sequence LPMA corresponding to amino acids 236-239 of HUMDNASEI_PEA_1_P6, wherein said first amino acid sequence and second amino acid sequence are contiguous and in a sequential order.

2. An isolated polypeptide for a tail of HUMDNASEI_PEA_1_P6, comprising a polypeptide being at least 70%, optionally at least about 80%, preferably at least about 85%, more preferably at least about 90% and most preferably at least about 95% homologous to the sequence LPMA in HUMDNASEI_PEA_1_P6.

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMDNASEI_PEA_1_P6 also has the following non-silent SNPs (Single Nucleotide Polymorphisms) as listed in Table 459, (given according to their position(s) on the amino acid sequence, with the alternative amino acid(s) listed; the last column indicates whether the SNP is known or not; the presence of known SNPs in variant protein HUMDNASEI_PEA_1_P6 sequence provides support for the deduced sequence of this variant protein according to the present invention).

TABLE 459

| Amino acid mutations | | |
|---|---|---|
| SNP position(s) on amino acid sequence | Alternative amino acid(s) | Previously known SNP? |
| 2 | R → S | Yes |
| 15 | A → | No |
| 18 | Q → | No |
| 107 | R → G | Yes |
| 117 | Y → S | No |
| 127 | G → R | Yes |
| 154 | P → A | Yes |
| 231 | C → Y | Yes |
| 239 | A → T | Yes |

The glycosylation sites of variant protein HUMDNASEI_PEA_1_P6, as compared to the known protein Deoxyribonuclease I precursor, are described in Table 460 (given according to their position(s) on the amino acid sequence in the first column; the second column indicates whether the glycosylation site is present in the variant protein; and the last column indicates whether the position is different on the variant protein).

TABLE 460

| Glycosylation site(s) | | |
|---|---|---|
| Position(s) on known amino acid sequence | Present in variant protein? | Position in variant protein? |
| 128 | yes | 128 |
| 40 | yes | 40 |

The variant protein has the following domains, as determined by using InterPro. The domains are described in Table 461:

TABLE 461

| InterPro domain(s) | | | |
|---|---|---|---|
| InterPro ID | Domain description | Analysis type | Position(s) on protein |
| IPR008185 | Deoxyribonuclease I | FPrintScan | 102-131, 147-176, 177-206, 207-236, 33-62, 63-92 |
| IPR005135 | Endonuclease/ exonuclease/ phosphatase | HMMPfam | 23-236 |
| IPR008185 | Deoxyribonuclease I | HMMSmart | 6-239 |
| IPR008185 | Deoxyribonuclease I | ScanRegExp | 189-196 |
| IPR008185 | Deoxyribonuclease I | ScanRegExp | 152-172 |

Variant protein HUMDNASEI_PEA_1_P6 is encoded by the following transcript(s): HUMDNASEI_PEA_1_T7. The coding portion of transcript HUMDNASEI_PEA_1_T7 starts at position 1063 and ends at position 1779. The transcript also has the following SNPs as listed in Table 462 (given according to their position on the nucleotide sequence, with the alternative nucleic acid listed; the last column indicates whether the SNP is known or not; the presence of known SNPs in variant protein HUMDNASEI_PEA_1_P6 sequence provides support for the deduced sequence of this variant protein according to the present invention).

TABLE 462

| Nucleic acid SNPs | | |
|---|---|---|
| SNP position on nucleotide sequence | Alternative nucleic acid | Previously known SNP? |
| 487 | A → C | No |
| 917 | G → | No |
| 1031 | G → A | Yes |
| 1068 | G → T | Yes |
| 1106 | C → | No |
| 1116 | G → | No |
| 1158 | A → C | Yes |
| 1329 | C → G | Yes |
| 1381 | A → G | Yes |
| 1412 | A → C | No |
| 1441 | G → A | Yes |
| 1522 | C → G | Yes |
| 1590 | C → G | Yes |
| 1629 | C → T | Yes |
| 1686 | G → A | Yes |
| 1754 | G → A | Yes |
| 1777 | G → A | Yes |
| 1804 | T → A | No |
| 1846 | C → A | No |

TABLE 462-continued

| Nucleic acid SNPs | | |
|---|---|---|
| SNP position on nucleotide sequence | Alternative nucleic acid | Previously known SNP? |
| 1847 | C → A | No |
| 1858 | C → G | Yes |

Variant protein HUMDNASEI_PEA_1_P10 (SEQ ID NO:1130) according to the present invention is encoded by transcript(s) HUMDNASEI_PEA_1_T13. An alignment is given to the known protein (Deoxyribonuclease I precursor) in FIG. 267. One or more alignments to one or more previously published protein sequences are given in FIGS. 264-267. A brief description of the relationship of the variant protein according to the present invention to each such aligned protein is as follows:

Comparison Report Between HUMDNASEI_PEA_1_P10 and DRN1_HUMAN:

1. An isolated chimeric polypeptide HUMDNASEI_PEA_1_P10, comprising a first amino acid sequence being at least 90% homologous to MRGMKLLGALLALAALLQ-GAVSLKIAAFNIQTFGETKMSNATLVSYIVQILSR YDI-ALVQEVRDSHLTAVGKLLDNLNQDAPD-TYHYVVSEPLGRNSYKERYLF VYRPDQVSAVDSYYYDDGCEPCGNDTFN-REPAIVRFFSRFT corresponding to amino acids 1-145 of DRN1_HUMAN, which also corresponds to amino acids 1-145 of HUMDNASEI_PEA_1_P10, and a second amino acid sequence being at least 70%, optionally at least 80%, preferably at least 85%, more preferably at least 90% and most preferably at least 95% homologous to a polypeptide having the sequence GPQAAFPGRTSC corresponding to amino acids 146-157 of HUMDNASEI_PEA_1_P10, wherein said first amino acid sequence and second amino acid sequence are contiguous and in a sequential order.

2. An isolated polypeptide for a tail of HUMDNASEI_PEA_1_P10, comprising a polypeptide being at least 70%, optionally at least about 80%, preferably at least about 85%, more preferably at least about 90% and most preferably at least about 95% homologous to the sequence GPQAAF-PGRTSC in HUMDNASEI_PEA_1_P10.

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMDNASEI_PEA_1_P10 also has the following non-silent SNPs (Single Nucleotide Polymorphisms) as listed in Table 463, (given according to their position(s) on the amino acid sequence, with the alternative amino acid(s) listed; the last column indicates whether the SNP is known or not; the presence of known SNPs in variant protein HUMDNASEI_PEA_1_P10 sequence provides support for the deduced sequence of this variant protein according to the present invention).

TABLE 463

Amino acid mutations

| SNP position(s) on amino acid sequence | Alternative amino acid(s) | Previously known SNP? |
|---|---|---|
| 2 | R → S | Yes |
| 15 | A → | No |
| 18 | Q → | No |
| 107 | R → G | Yes |
| 117 | Y → S | No |
| 127 | G → R | Yes |

The glycosylation sites of variant protein HUMDNASEI_PEA_1_P10, as compared to the known protein Deoxyribonuclease I precursor, are described in Table 464 (given according to their position(s) on the amino acid sequence in the first column; the second column indicates whether the glycosylation site is present in the variant protein; and the last column indicates whether the position is different on the variant protein).

TABLE 464

Glycosylation site(s)

| Position(s) on known amino acid sequence | Present in variant protein? | Position in variant protein? |
|---|---|---|
| 128 | yes | 128 |
| 40 | yes | 40 |

The variant protein has the following domains, as determined by using InterPro. The domains are described in Table 465:

TABLE 465

InterPro domain(s)

| InterPro ID | Domain description | Analysis type | Position(s) on protein |
|---|---|---|---|
| IPR008185 | Deoxyribonuclease I | FPrintScan | 102-131, 33-62, 63-92 |
| IPR008185 | Deoxyribonuclease I | HMMSmart | 6-157 |

Variant protein HUMDNASEI_PEA_1_P10 is encoded by the following transcript(s): HUMDNASEI_PEA_1_T13. The coding portion of transcript HUMDNASEI_PEA_1_T13 starts at position 1063 and ends at position 1533. The transcript also has the following SNPs as listed in Table 466 (given according to their position on the nucleotide sequence, with the alternative nucleic acid listed; the last column indicates whether the SNP is known or not; the presence of known SNPs in variant protein HUMDNASEI_PEA_1_P10 sequence provides support for the deduced sequence of this variant protein according to the present invention).

TABLE 466

Nucleic acid SNPs

| SNP position on nucleotide sequence | Alternative nucleic acid | Previously known SNP? |
|---|---|---|
| 487 | A → C | No |
| 917 | G → | No |
| 1031 | G → A | Yes |
| 1068 | G → T | Yes |
| 1106 | C → | No |

TABLE 466-continued

Nucleic acid SNPs

| SNP position on nucleotide sequence | Alternative nucleic acid | Previously known SNP? |
|---|---|---|
| 1116 | G → | No |
| 1158 | A → C | Yes |
| 1329 | C → G | Yes |
| 1381 | A → G | Yes |
| 1412 | A → C | No |
| 1441 | G → A | Yes |
| 1500 | G → C | Yes |
| 1541 | C → T | Yes |
| 1598 | G → A | Yes |
| 1666 | G → A | Yes |
| 1705 | G → A | Yes |
| 1710 | G → C | Yes |
| 1759 | G → A | Yes |
| 1786 | T → A | No |
| 1828 | C → A | No |
| 1829 | C → A | No |
| 1840 | C → G | Yes |

Example 68

Description for Cluster HUMTNFAA

Cluster HUMTNFAA features 3 transcript(s) and 9 segment(s) of interest, the names for which are given in Tables 467 and 468, respectively. The selected protein variants are given in Table 469.

TABLE 467

Transcripts of interest

| Transcript Name | SEQ ID NO: |
|---|---|
| HUMTNFAA_PEA_1_T1 | 1132 |
| HUMTNFAA_PEA_1_T2 | 1133 |
| HUMTNFAA_PEA_1_T5 | 1134 |

TABLE 468

Segments of interest

| Segment Name | SEQ ID NO: |
|---|---|
| HUMTNFAA_PEA_1_node_0 | 1135 |
| HUMTNFAA_PEA_1_node_2 | 1136 |
| HUMTNFAA_PEA_1_node_3 | 1137 |
| HUMTNFAA_PEA_1_node_5 | 1138 |
| HUMTNFAA_PEA_1_node_7 | 1139 |
| HUMTNFAA_PEA_1_node_8 | 1140 |
| HUMTNFAA_PEA_1_node_9 | 1141 |
| HUMTNFAA_PEA_1_node_4 | 1142 |
| HUMTNFAA_PEA_1_node_6 | 1143 |

TABLE 469

Proteins of interest

| Protein Name | SEQ ID NO: | Protein Length | Corresponding Transcripts(s) |
|---|---|---|---|
| HUMTNFAA_PEA_1_P6 | 1144 | P143 | HUMTNFAA_PEA_1_T1 |
| HUMTNFAA_PEA_1_P7 | 1145 | P73 | HUMTNFAA_PEA_1_T2 |
| HUMTNTAA_PEA_1_P8 | 1146 | P217 | HUMTNFAA_PEA_1_T5 |

These sequences are variants of the known protein Tumor necrosis factor precursor (SwissProt accession identifier TNFA_HUMAN; SEQ ID NO:1155; known also according to the synonyms TNF-alpha; Tumor necrosis factor ligand superfamily member 2; TNF-a; Cachectin), referred to herein as the previously known protein.

Protein Tumor necrosis factor precursor is known or believed to have the following function(s): Cytokine that binds to TNFRSF1A/TNFR1 and TNFRSF1B/TNFBR. It is mainly secreted by macrophages and can induce cell death of certain tumor cell lines. It is potent pyrogen causing fever by direct action or by stimulation of interleukin 1 secretion and is implicated in the induction of cachexia, Under certain conditions it can stimulate cell proliferation and induce cell differentiation. The sequence for protein Tumor necrosis factor precursor is seqt forth by SEQ ID NO:1147, as "Tumor necrosis factor precursor amino acid sequence". Known polymorphisms for this sequence are as shown in Table 470.

TABLE 470

Amino acid mutations for Known Protein

| SNP position(s) on amino acid sequence | Comment |
|---|---|
| 94 | A → T (in dbSNP: 1800620)./FTId = VAR_011927. |
| 105 | L → S: Low activity. |
| 108 | R → W: Biologically inactive. |
| 112 | L → F: Biologically inactive. |
| 160 | A → V: Biologically inactive. |
| 162 | S → F: Biologically inactive. |
| 167 | V → A, D: Biologically inactive. |
| 222 | E → K: Biologically inactive. |
| 63 | F → S |
| 84-86 | PSD → VNR |
| 183 | E → R |

Protein Tumor necrosis factor precursor localization is believed to be Type II membrane protein. Also exists as an extracellular soluble form.

The previously known protein also has the following indication(s) and/or potential therapeutic use(s): Cancer, head and neck; Cancer, squamous cell; Infection, HIV/AIDS; Cancer, pancreatic; Arthritis, rheumatoid; Multiple sclerosis. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein or of drugs directed against this protein are as follows: Tumour necrosis factor modulator; Tumour necrosis factor alpha modulator. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticancer; Radio/chemoprotective; Antiviral; Immunosuppressant; antibody; Antidiabetic; GI inflammatory/bowel disorders; Antipsoriasis; Antiarthritic, immunological; Monoclonal antibody, humanized; Anti-inflammatory; Monoclonal antibody, chimaeric; Septic shock treatment; Cytokine; Cardiovascular; Antiviral, anti-HIV; Anti-infective; Multiple sclerosis treatment; Antimycobacterial.

The following GO Annotation(s) apply to the previously known protein. The following annotation(s) were found: transcription regulation; apoptosis; anti-apoptosis; inflammatory response; immune response; leukocyte cell adhesion; signal transduction; cell-cell signaling; necrosis; response to viruses, which are annotation(s) related to Biological Process; tumor necrosis factor receptor ligand, which are annotation(s) related to Molecular Function; and soluble fraction; integral membrane protein, which are annotation(s) related to Cellular Component.

The GO assignment relies on information from one or more of the SwissProt/TremB1 Protein knowledgebase, or Locuslink.

As noted above, cluster HUMTNFAA features 3 transcript(s), which were listed in Table 1 above. These transcript(s) encode for protein(s) which are variant(s) of protein Tumor necrosis factor precursor. A description of each variant protein according to the present invention is now provided.

Variant protein HUMTNFAA_PEA__1_P6 (SEQ ID NO:1144) according to the present invention is encoded by transcript(s) HUMTNFAA_PEA__1_T1. An alignment is given to the known protein (Tumor necrosis factor precursor) in FIG. 268. One or more alignments to one or more previously published protein sequences are given in FIGS. 268-270. A brief description of the relationship of the variant protein according to the present invention to each such aligned protein is as follows:

Comparison Report Between HUMTNFAA_PEA__1_P6 and TNFA_HUMAN

1. An isolated chimeric polypeptide HUMTNFAA_PEA__1_P6, comprising a first amino acid sequence being at least 90% homologous to MSTESMIRDVELAEEALPKKTGG-PQGSRRCLFLSLFSFLIVAGATTLFCLLHFG VIG-PQREE corresponding to amino acids 1-62 of TNFA_HUMAN, which also corresponds to amino acids 1-62 of HUMTNFAA_PEA__1_P6, and a second amino acid sequence being at least 70%, optionally at least 80%, preferably at least 85%, more preferably at least 90% and most preferably at least 95% homologous to a polypeptide having the sequence VSAWPAFIHSPTQGEMETQERERDG-MGERCALIGRDGEKKTWRKTGMQKE MWQEMGKRERERWRDRMSGTWKVLTKCVWSE corresponding to amino acids 63-143 of HUMTNFAA_PEA__1_P6, wherein said first amino acid sequence and second amino acid sequence are contiguous and in a sequential order.

2. An isolated polypeptide for a tail of HUMTNFAA_PEA__1_P6, comprising a polypeptide being at least 70%, optionally at least about 80%, preferably at least about 85%, more preferably at least about 90% and most preferably at least about 95% homologous to the sequence VSAWPAFIH-SPTQGEMETQERERDGMGERCALI-GRDGEKKTWRKTGMQKE MWQEMGKRE-RERWRDRMSGTWKVLTKCVWSE in HUMTNFAA_PEA__1_P6.

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMTNFAA_PEA_1_P6 also has the following non-silent SNPs (Single Nucleotide Polymorphisms) as listed in Table 471, (given according to their position(s) on the amino acid sequence, with the alternative amino acid(s) listed; the last column indicates whether the SNP is known or not; the presence of known SNPs in variant protein HUMTNFAA_PEA_1_P6 sequence provides support for the deduced sequence of this variant protein according to the present invention).

TABLE 471

Amino acid mutations

| SNP position(s) on amino acid sequence | Alternative amino acid(s) | Previously known SNP? |
|---|---|---|
| 41 | V → M | No |
| 52 | H → N | Yes |
| 103 | T → S | Yes |

The variant protein has the following domains, as determined by using InterPro. The domains are described in Table 472:

TABLE 472

InterPro domain(s)

| InterPro ID | Domain description | Analysis type | Position(s) on protein |
|---|---|---|---|
| IPR002959 | Tumour necrosis factor alpha/cachectin | FPrintScan | 2-20, 20-35, 43-62 |

Variant protein HUMTNFAA_PEA_1_P6 (SEQ ID NO:1144) is encoded by the following transcript(s): HUMTNFAA_PEA_1_T1. The coding portion of transcript HUMTNFAA_PEA_1_T1 starts at position 178 and ends at position 606. The transcript also has the following SNPs as listed in Table 473 (given according to their position on the nucleotide sequence, with the alternative nucleic acid listed; the last column indicates whether the SNP is known or not; the presence of known SNPs in variant protein HUMTNFAA_ PEA_1_P6 sequence provides support for the deduced sequence of this variant protein according to the present invention).

TABLE 473

Nucleic acid SNPs

| SNP position on nucleotide sequence | Alternative nucleic acid | Previously known SNP? |
|---|---|---|
| 7 | C → T | Yes |
| 65 | C → G | Yes |
| 150 | C → T | Yes |
| 264 | G → T | Yes |
| 298 | G → A | No |
| 331 | C → A | Yes |
| 417 | G → A | Yes |
| 484 | A → T | Yes |
| 486 | G → A | Yes |
| 686 | G → | Yes |
| 848 | A → G | Yes |
| 884 | T → C | Yes |
| 1077 | G → A | Yes |
| 1165 | T → C | Yes |

TABLE 473-continued

Nucleic acid SNPs

| SNP position on nucleotide sequence | Alternative nucleic acid | Previously known SNP? |
|---|---|---|
| 1221 | C → T | Yes |
| 2701 | → C | No |

Variant protein HUMTNFAA_PEA_1_P7 (SEQ ID NO:1145) according to the present invention is encoded by transcript(s) HUMTNFAA_PEA_1_T2. An alignment is given to the known protein (Tumor necrosis factor precursor) in FIG. 269. One or more alignments to one or more previously published protein sequences are given in FIGS. 268-270. A brief description of the relationship of the variant protein according to the present invention to each such aligned protein is as follows:

Comparison Report Between HUMTNFAA_PEA_1_P7 and TNFA_HUMAN:

1. An isolated chimeric polypeptide HUMTNFAA_ 1_P7, comprising a first amino acid sequence being at least 90% homologous to MSTESMIRDVELAEEALPKKTGG-PQGSRRCLFLSLFSFLIVAGATTLFCLLHFG VIG-PQREE corresponding to amino acids 1-62 of TNFA_HUMAN, which also corresponds to amino acids 1-62 of HUMTNFAA_PEA_1_P7, and a second amino acid sequence being at least 70%, optionally at least 80%, preferably at least 85%, more preferably at least 90% and most preferably at least 95% homologous to a polypeptide having the sequence QTLKLRGSSSG corresponding to amino acids 63-73 of HUMTNFAA_PEA_1_P7, wherein said first amino acid sequence and second amino acid sequence are contiguous and in a sequential order.

2. An isolated polypeptide for a tail of HUMTNFAA_ PEA_1_P7, comprising a polypeptide being at least 70%, optionally at least about 80%, preferably at least about 85%, more preferably at least about 90% and most preferably at least about 95% homologous to the sequence QTLKL-RGSSSG in HUMTNFAA_PEA_1_P7.

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMTNFAA_PEA_1_P7 also has the following non-silent SNPs (Single Nucleotide Polymorphisms) as listed in Table 474, (given according to their position(s) on the amino acid sequence, with the alternative amino acid(s) listed; the last column indicates whether the SNP is known or not; the presence of known SNPs in variant protein HUMTNFAA_PEA_1_P7 sequence provides support for the deduced sequence of this variant protein according to the present invention).

TABLE 474

Amino acid mutations

| SNP position(s) on amino acid sequence | Alternative amino acid(s) | Previously known SNP? |
|---|---|---|
| 41 | V → M | No |
| 52 | H → N | Yes |

The phosphorylation sites of variant protein HUMTNFAA_PEA_1_P7, as compared to the known protein Tumor necrosis factor precursor, are described in Table 475 (given according to their position(s) on the amino acid sequence in the first column; the second column indicates whether the phosphorylation site is present in the variant protein; and the last column indicates whether the position is different on the variant protein).

TABLE 475

| Phosphorylation site(s) | | |
|---|---|---|
| Position(s) on known amino acid sequence | Present in variant protein? | Position in variant protein? |
| 2 | yes | 2 |

The variant protein has the following domains, as determined by using InterPro. The domains are described in Table 476:

TABLE 476

| InterPro domain(s) | | | |
|---|---|---|---|
| InterPro ID | Domain description | Analysis type | Position(s) on protein |
| IPR002959 | Tumour necrosis factor alpha/cachectin | FPrintScan | 2-20, 20-35, 43-62 |

Variant protein HUMTNFAA_PEA_1_P7 is encoded by the following transcript(s): HUMTNFAA_PEA_1_T2. The coding portion of transcript HUMTNFAA_PEA_1_T2 starts at position 178 and ends at position 396. The transcript also has the following SNPs as listed in Table 477 (given according to their position on the nucleotide sequence, with the alternative nucleic acid listed; the last column indicates whether the SNP is known or not; the presence of known SNPs in variant protein HUMTNFAA_PEA_1_P7 sequence provides support for the deduced sequence of this variant protein according to the present invention).

TABLE 477

| Nucleic acid SNPs | | |
|---|---|---|
| SNP position on nucleotide sequence | Alternative nucleic acid | Previously known SNP? |
| 7 | C → T | Yes |
| 65 | C → G | Yes |
| 150 | C → T | Yes |
| 264 | G → T | Yes |
| 298 | G → A | No |
| 331 | C → A | Yes |
| 1513 | → C | No |

Variant protein HUMTNFAA_PEA_1_P8 (SEQ ID NO:1146) according to the present invention is encoded by transcript(s) HUMTNFAA_PEA_1_T5. An alignment is given to the known protein (Tumor necrosis factor precursor) in FIG. 270. One or more alignments to one or more previously published protein sequences are given in FIGS. 268-270. A brief description of the relationship of the variant protein according to the present invention to each such aligned protein is as follows:

Comparison Report Between HUMTNFAA_PEA_1_P8 and TNFA_HUMAN_V1 (SEQ ID NO:1147):

1. An isolated chimeric polypeptide HUMTNFAA_PEA_1_P8, comprising a first amino acid sequence being at least 90% homologous to MSTESMIRDVELAEEALPKKTGG-PQGSRRCLFLSLFSFLIVAGATTLFCLLHFG VIG-PQREEFPRDLSLISPLAQA corresponding to amino acids 1-76 of TNFA_HUMAN_V1, which also corresponds to amino acids 1-76 of HUMTNFAA_PEA_1_P8, and a second amino acid sequence being at least 90% homologous to VTNPQAEGQLQWLNRRANALLANGVEL-RDNQLVVPSEGLYLIYSQVLFKGQ GCPSTHVLLTH-TISRIAVSYQTKVNLLSAIKSPCQRET-PEGAEAKPWYEPIYLG GVFQLEKGDRLSAEINRPDYLDFAESGQVYFGIIAL corresponding to amino acids 93-233 of TNFA_HUMAN_V1, which also corresponds to amino acids 77-217 of HUMTNFAA_PEA_1_P8, wherein said first amino acid sequence and second amino acid sequence are contiguous and in a sequential order.

2. An isolated chimeric polypeptide for an edge portion of HUMTNFAA_PEA_1_P8, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AV, having a structure as follows: a sequence starting from any of amino acid numbers 76-x to 76; and ending at any of amino acid numbers 77+((n−2)−x), in which x varies from 0 to n−2.

It should be noted that the known protein sequence (TNFA_HUMAN) has one or more changes than the sequence set forth by SEQ ID NO:1155 and named as being the amino acid sequence for TNFA_HUMAN_V1 (SEQ ID NO:1147). These changes were previously known to occur and are listed in the Table 478 below.

TABLE 478

| Changes to TNFA_HUMAN_V1 | |
|---|---|
| SNP position(s) on amino acid sequence | Type of change |
| 95 | variant |

The location of the variant protein was determined according to results from a number of different software programs and analyses, including analyses from SignalP and other specialized programs. The variant protein is believed to be located as follows with regard to the cell: membrane. The protein localization is believed to be membrane because the Signalp_hmm software predicts that this protein has a signal anchor region.

Variant protein HUMTNFAA_PEA_1_P8 also has the following non-silent SNPs (Single Nucleotide Polymorphisms) as listed in Table 479, (given according to their position(s) on the amino acid sequence, with the alternative amino acid(s) listed; the last column indicates whether the SNP is known or not; the presence of known SNPs in variant protein HUMTNFAA_PEA_1_P8 sequence provides support for the deduced sequence of this variant protein according to the present invention).

TABLE 479

| Amino acid mutations | | |
|---|---|---|
| SNP position(s) on amino acid sequence | Alternative amino acid(s) | Previously known SNP? |
| 41 | V → M | No |
| 52 | H → N | Yes |

The variant protein has the following domains, as determined by using InterPro. The domains are described in Table 480:

TABLE 480

InterPro domain(s)

| InterPro ID | Domain description | Analysis type | Position(s) on protein |
|---|---|---|---|
| IPR006053 | Tumor necrosis factor alpha, beta and c | FPrintScan | 136-154, 174-197, 205-216, 71-88, 88-106 |
| IPR002959 | Tumour necrosis factor alpha/cachectin | FPrintScan | 190-209, 2-20, 20-35, 43-62 |
| IPR006052 | Tumor Necrosis Factor | HMMPfam | 71-217 |
| IPR006052 | Tumor Necrosis Factor | HMMSmart | 72-217 |
| IPR006052 | Tumor Necrosis Factor | ScanRegExp | 108-124 |
| IPR003636 | Tumour necrosis factor subfamily | BlastProDom | 72-217 |
| IPR006052 | Tumor Necrosis Factor | ProfileScan | 74-217 |

Variant protein HUMTNFAA_PEA_1_P8 is encoded by the following transcript(s): HUMTNFAA_PEA_1_T5. The coding portion of transcript HUMTNFAA_PEA_1_T5 starts at position 178 and ends at position 828. The transcript also has the following SNPs as listed in Table 481 (given according to their position on the nucleotide sequence, with the alternative nucleic acid listed; the last column indicates whether the SNP is known or not; the presence of known SNPs in variant protein HUMTNFAA_PEA_1_P8 sequence provides support for the deduced sequence of this variant protein according to the present invention).

TABLE 481

Nucleic acid SNPs

| SNP position on nucleotide sequence | Alternative nucleic acid | Previously known SNP? |
|---|---|---|
| 7 | C → T | Yes |
| 65 | C → G | Yes |
| 150 | C → T | Yes |
| 264 | G → T | Yes |
| 298 | G → A | No |
| 331 | C → A | Yes |
| 1559 | → C | No |

Example 69

RETT Syndrome

Rett syndrome is a genetic disease which has profound neurological effects. It primarily affects girls. Although seemingly normal at birth and as babies, children affected with this disorder begin to develop symptoms between 6 to 18 months of age. At this point, they cease to play and to communicate, losing speech and both gross and fine motor skills, and instead develop a set of repetitive behaviors. These behaviors include stereotypic hand movements and teeth grinding. Children with this syndrome may also develop seizures and ataxia, and may in fact lose the ability to walk or even to move, and to self-feed. Despite the severity of these symptoms, children affected by the disorder often survive well into adulthood. Typically, the symptoms do not progress in severity beyond that of initial onset.

Rett syndrome has been found to be caused by defects in the MECP2 gene (see MEC2_HUMAN for the SwissProt entry). At least 80% of Rett syndrome patients have been found to carry defects in this gene. This protein binds to methylated DNA, and specifically methylated CpG. DNA methylation involves modifying carbon-5 of the cytosine pyrimidine ring, predominantly at CpG nucleotides. It is involved in silencing of genes during development for example.

Unmethylated genes remain active. Mutations in MECP2 may be involved in other types of retardation as well.

Rett syndrome itself occurs due to mosaicism, as MECP2 is X-linked. Rett syndrome patients therefore have a mosaic of normal and mutated genes, which is presumably why more females are affected by the disease than males: males with the defect typically (although not always) demonstrate much more severe side effects and die within the first two years of life (see Kriaucionis and Bird, Human Molec Genetics, 2003, vol 12, R221-227).

Recent research has found that mutations in this gene, resulting in a defective protein, lead to defects in the three-dimensional folding of chromatin, which in turn leads to Rett syndrome (Horike et al, Nat Genet. 2005 January; 37(1):31-40). Mecp2 was shown to target histone deacetylase 1 to a particular region of DNA that was studied, and to promote repressive histone methylation at this site. Mecp2 (in conjunction with other proteins) enabled a silent chromatin-derived 11-kb chromatin loop to be formed at this locus. Mice lacking the MECP2 gene also lacked this silent chromatin loop. Thus, it is believed that defects in the gene which result in a defective protein prevent silent chromatin loops from forming, thereby leading to Rett syndrome.

The Mecp2 protein has a methyl-CpG binding domain (MBD) at amino acid residues 90-162. Defects in this domain have been shown to be responsible for Rett syndrome in some patients. Another important domain is the transcription repression domain (TRD), which is in two parts at amino acid residues 185-277. Mutations for this domain were also found to be responsible for Rett syndrome in some patients.

A splice variant for Mecp2 has been found, which results in a longer protein (498 amino acids as opposed to 486 amino acids for the known or WT protein; see Mnatzakanian et al, Nature Genetics, vol 36, April 2004, 1-3; accession number MECP2B or AY541280). This protein is translated starting from exon 1, which forms part of the 5' UTR in normal individuals.

According to preferred embodiments of the present invention, there are provided novel splice variants of Mecp2. These splice variants are either truncation (variant 2, SEQ ID NO:1148 and variant 3, SEQ ID NO:1152) or extension mutations (variant 1, SEQ ID NO:1150). Alignments are shown herein (FIGS. 271-273) with regard to the known or WT form of this protein, which does not result in disease (SEQ ID NO:1154). Each of these variants is described in greater detail. The variants according to the present invention may optionally be used for diagnostic testing of individuals, for example with NAT based testing of biological samples from affected individuals. These variants may also optionally be used as targets for therapeutic agents, such as small molecules, which may optionally be used to treat Rett syndrome, for example. The variants themselves may optionally be useful as therapeutic agents.

Probes associated with these variants, including but not limited to, antibodies or fragments thereof, oligonucleotides capable of specifically hybridizing to the related transcripts or fragments thereof, primer pairs capable of specifically amplifying these transcripts or fragments thereof, or any other such probe, also form preferred embodiments of the present invention. Preferably, the probe is capable of distinguishing between the splice variant and the known protein or known transcript, and optionally and preferably may also be able to distinguish between different splice variants.

Rett Syndrome Variant 1 (M62144_P2—SEQ ID NO:1150; M62144_T12—SEQ ID NO:1151)

As noted above, variant 1 is an extension mutation, resulting in a longer protein of 508 amino acids (SEQ ID NO:1150). As shown with regard to the alignment (FIG. 272), amino acids 9-486 from the known protein are in the variant amino acid sequence, with an addition of a unique head of 30 amino acids.

Rett Syndrome Variant 2 (M62144_P3—SEQ ID NO:1148; M62144_T13—SEQ ID NO:1149)

As noted above, variant 2 is a truncation mutation, resulting in a protein of 379 amino acids (SEQ ID NO:1148). As shown with regard to the alignment between this variant and the WT or known protein (FIG. 271), this protein is truncated. It features amino acid residues 1-376 that are identical to the known protein and a tail of 3 unique amino acids (TST). It therefore lacks a proline-rich region at amino acids 376-405.

Rett Syndrome Variant 3 (M62144_P4—SEQ ID NO:1152; M62144_T14—SEQ ID NO:1153)

As noted above, variant 3 is a truncation mutation, resulting in a protein of 247 amino acids (SEQ ID NO:1152). As shown with regard to the alignment between this variant and the WT or known protein (FIG. 273), this protein is truncated. It features amino acid residues 1-243 that are identical to the known protein and a tail of 4 unique amino acids (PTST). It therefore lacks part of the TRD (DNA binding) region and the proline-rich region at amino acids 376-405.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims. All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention.

SEQUENCE LISTING (1155 sequences)

SEQ ID NO: 1 - protein, 103 aa, Homo sapiens
MSPEPALSPALQLLLWHSALWTVQEATPLGPASSLPQSFLLKCLEQVRKIQGDGAALQEKLCATYKLCHPEELVLLGHSLGIPWAPLSSCPSQALQLVSVRKG

SEQ ID NO: 2 - protein, 6 aa, Homo sapiens
  misc_feature: GCSF unique region
VSVRKG

SEQ ID NO: 3 - DNA, 1912 bp, Homo sapiens
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatgggtgagtgtcttggcccaggatgggagagccgcctgccctggcatgggagggaggctggtgtgacagaggggctggggatccccgttctgggaatggggattaaaggcacccagtgtccccgagagggcctcaggtggtagggaacagcatgtctcctgagcccgctctgtccccagccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggtgagtgtcaggaaaggataaggctaatgaggagggggaaggagaggaggaacacccatgggctcccccatgtctccaggttccaagctgggggcctgacgtatctcaggcagcaccccctaactcttccgctctgtctcacaggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaacgtcc

SEQ ID NO: 4 - DNA, 144 bp, Homo sapiens
  misc_feature: GCSF unique region
ggtgagtgtcaggaaaggataaggctaatgaggagggggaaggagaggaggaacacccatgggctcccccatgtctccaggttccaagctgggggcctgacgtatctcaggcagcaccccctaactcttccgctctgtctcaca

SEQ ID NO: 5 - protein, 166 aa, Homo sapiens [sequence omitted]

SEQ ID NO: 6 - protein, 9 aa, Homo sapiens
  misc_feature: HUMTNFRRP_P14  Unique region
GQRSLRGWM

SEQ ID NO: 7 - DNA, 808 bp, Homo sapiens
gattgcgacaggccggcctggctcccagcgctccctgtccccgccccgcggccagctcgctccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaaggtcagaggtccctgaggggctggatgtgaaaaggaggctgggtgccagggatctcaagtgggagcagggaatatgg

SEQ ID NO: 8 - DNA, 77 bp, Homo sapiens
  misc_feature: TRN3 unique region
ggtcagaggtccctgaggggctggatgtgaaaaggaggctgggtgccagggatctcaagtgggagcagggaatatgg

SEQ ID NO: 9 - protein, 126 aa, Homo sapiens
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVPRKAY

SEQ ID NO: 10 - protein, 5 aa, Homo sapiens
  misc_feature: HSIL4R_T5  unique region
PRKAY

SEQ ID NO: 11 - DNA, 4766 bp, Homo sapiens
tgcagtgcccgacagattgtactagttactgattgaagggctgttttactatccaaatgtggctggagtaggagttgggtaaacatttattgaagaatgtgcaaccactctcacttggaagccgggctgttaggaaggggaggaggattccagtcgcccagccctcccccaccaaacgcaactgccccggcgcaaaagaggccgcggaggccaggcaggagcaggtcctggaggcctggtcggcgtgggcgttttattccgagaccaaggggatccactgcagagttctccgctgggcgtgacctcgggctacggcgtgggaggaagcgcgcggcaagacacccagcgaggtgctggggtcgcccccaggagaggacggcggctcggactgtccggcggcggcggcggggacagcgacaggggcgcgaggtggccgggacccgggccgggcgcgccgggcggggcggcgcatgcaaatctgccgggcgccggggcggggagcaggaagccggggcgggctgggtctccgcgcccaggaaagccccgcgcggcgcgggccagggaagggccacccaggggtcccccacttcccgcttgggcgcccggacggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgcccaggaaggcgtattgagatgaggtgtgcttgctggaaggcatgcctgctgctgattgaaaaccgaactgggaacagtccttccattctgtgtccactggtcagctgctgcggctttggatggtcttgaccgtggaaggctgaccttcttctggtacccggagtccctgcaggaatcccccttgagcttgctgggctgtggtgacaggagtttaaaacatgcgttgtattccagtgatgcatgatatgacatgcatcacaggaataaaaacctgaggtctcatggatatgattgcttcaaaggagaccaagttttaaaacagatgaatcaaaataaagaaaaatactcagtaaatcatcataaagtacagagatgtggccaaaggtgtgaaggatgcagctgtaaaagctgaagtttgaggccgggtgtggtggttcatgcctataatcccagcactttgggaggccgagcccagcggatcaccggaggtcaggagttcgagaccagcctggacaacatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagccccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacatggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctgtgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctctttaaaaattatgtattaaccaaacatacctccagac

SEQ ID NO: 12 - DNA, 523 bp, Homo sapiens
  misc_feature: IL4R unique region
catgtgcccaggaaggcgtattgagatgaggtgtgcttgctggaaggcatgcctgctgctgattgaaaaccgaactgggaacagtccttccattctgtgtccactggtcagctgctgcggctttggatggtcttgaccgtggaaggctgaccttcttctggtacccggagtccctgcaggaatcccccttgagcttgctgggctgtggtgacaggagtttaaaacatgcgttgtattccagtgatgcatgatatgacatgcatcacaggaataaaaacctgaggtctcatggatatgattgcttcaaaggagaccaagttttaaaacagatgaatcaaaataaagaaaaatactcagtaaatcatcataaagtacagagatgtggccaaaggtgtgaaggatgcagctgtaaaagctgaagtttgaggccgggtgtggtggttcatgcctataatcccagcactttgggaggccgagcccagcggatcaccggaggtcaggagttcgagaccagcctggacaa

SEQ ID NO: 13 - protein, 298 aa, Homo sapiens
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGENTEALRRKITCPKSLACNLLFRDSNGDSLTPEVFFMMLNKSFGL

SEQ ID NO: 14 - protein, 45 aa, Homo sapiens
  misc_feature: HUMVTNR_P5 unique region
ENTEALRRKITCPKSLACNLLFRDSNGDSLTPEVFFMMLNKSFGL

SEQ ID NO: 15 - DNA, 1602 bp, Homo sapiens
gataaaaagctttcctcatttttaaacaacagtcgcacggaagttcccggcgggacaagggaacgtgggtgcccttgctactcccgtggacgcgggtagattgggacgctggaccgtatctccccgcccccgcccccacgcctcctcaggtgctcagcctgaggccttcgtccaggagcgctgccgctgacccaggctcaggagctgggggcccctgcacagacgcccaggtctcgggacaggcggcgactgcactcacggaagtacgctgagctctcccctgtagaagggcgcctctcctcccccacttcctcctccagctccacagcagcctcccgggccggctcctcctccttccaggtctcctcccagtgccgccgcggctctcaggcctgaggtgcggcgctcaccccggcagtccccagcctcagacgctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggtgaaaacactgaggcactgagacgcaaaataacttgcccaaagtcactcgcttgtaacttgctgttcagagattcaaatggagacagtctaactcctgaagttttcttcatgatgttaaataaaagttttggtctttaggactta

SEQ ID NO: 16 - DNA, 145 bp, Homo sapiens
  misc_feature: ITAV unique region
tgaaaacactgaggcactgagacgcaaaataacttgcccaaagtcactcgcttgtaacttgctgttcagagattcaaatggagacagtctaactcctgaagttttcttcatgatgttaaataaaagttttggtctttaggactta

SEQ ID NO: 17 - protein, 269 aa, Homo sapiens
MVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEERIENIYSRHKIYKLSPETTYCLKVKAALLTSWKIGVYSPVHCIKTTVENELPPPENIEVSVQNQNYVLKWDYTYANMTFQVQWLHLYFRRPR

SEQ ID NO: 18 - protein, 7 aa, Homo sapiens
  misc_feature: T07758_P6  unique region
LYFRRPR

SEQ ID NO: 19 - DNA, 1463 bp, Homo sapiens
agaagaggcggcgcgtgcgtagaggggcggtgagagctaagaggggcagcgcgtgtgcagaggggcggtgtgacttaggacggggcgatggcggctgagaggagctgcgcgtgcgcgaacatgtaactggtgggatctgcggcggctcccagatgatggtcgtcctcctgggcgcgacgaccctagtgctcgtcgccgtggcgccatgggtgttgtccgcagccgcaggtggaaaaaatctaaaatctcctcaaaaagtagaggtcgacatcatagatgacaactttatcctgaggtggaacaggagcgatgagtctgtcgggaatgtgactttttcattcgattatcaaaaaactgggatggataattggataaaattgtctgggtgtcagaatattactagtaccaaatgcaacttttcttcactcaagctgaatgtttatgaagaaattaaattgcgtataagagcagaaaaagaaaacacttcttcatggtatgaggttgactcatttacaccatttcgcaaagctcagattggtcctccagaagtacatttagaagctgaagataaggcaatagtgatacacatctctcctggaacaaaagatagtgttatgtgggctttggatggtttaagctttacatatagcttagttatctggaaaaactcttcaggtgtagaagaaaggattgaaaatatttattccagacataaaatttataaactctcaccagagactacttattgtctaaaagttaaagcagcactacttacgtcatggaaaattggtgtctatagtccagtacattgtataaagaccacagttgaaaatgaactacctccaccagaaaatatagaagtcagtgtccaaaatcagaactatgttcttaaatgggattatacatatgcaaacatgacctttcaagttcagtggctccatttgtattttaggaggccgaggtaggtggatcacctgaggtcaggagttcaagaccagcctggccaacatgacgaaaccccatctctactaaaaatacaaaaattaggcaggcctggtggcgtgcacctgtaatcccagctactcagggggacagaggcaggagaattgcttgaacccaggaggcagaggttgcagtgagccaagatcctaccactccactccagcctgggtgacagagcgagactcggtctcaaaaaaaaagccaaaaaaaataaaccagcttgcagcattcctggaaattctaactaacagatgttcttgcatattgatatgagccacctccagcagagcacaacatgaccacagtctggaacagtctttggttttcttttatgttagatgcatatctcttccattgtttgtgagtttcctgagtgtggatactatttatttctgtaaccttagcccctaacatagtgtctggcaattgtaaatacttaataaatatctaatgaatttaaa

SEQ ID NO: 20 - DNA, 523 bp, Homo sapiens
  misc_feature: INR1 unique region
tttgtattttaggaggccgaggtaggtggatcacctgaggtcaggagttcaagaccagcctggccaacatgacgaaaccccatctctactaaaaatacaaaaattaggcaggcctggtggcgtgcacctgtaatcccagctactcagggggacagaggcaggagaattgcttgaacccaggaggcagaggttgcagtgagccaagatcctaccactccactccagcctgggtgacagagcgagactcggtctcaaaaaaaaagccaaaaaaaataaaccagcttgcagcattcctggaaattctaactaacagatgttcttgcatattgatatgagccacctccagcagagcacaacatgaccacagtctggaacagtctttggttttcttttatgttagatgcatatctcttccattgtttgtgagtttcctgagtgtggatactatttatttctgtaaccttagcccctaacatagtgtctggcaattgtaaatacttaataaatatctaatgaatttaaa

SEQ ID NO: 21 - DNA, 19 bp, Artificial sequence
  Single strand DNA oligonucleotide
gaggcgaggagtgtggcac

SEQ ID NO: 22 - DNA, 17 bp, Artificial sequence
  Single strand DNA oligonucleotide
gctgcgatgggcacgtt

SEQ ID NO: 23 - DNA, 130 bp, Artificial sequence
  Human Troponin PCR amplicon
gaggcgaggagtgtggcactttggcggggaaggggcggctcagccctcgggccctcgcccgccctctccgggtctggagcgtctcctcgcgccatccctgcaccgccagggggaacgtgcccatcgcagc

SEQ ID NO: 24 - DNA, 20 bp, Artificial sequence
  Single strand DNA oligonucleotide
tgggaacaagagggcatctg

SEQ ID NO: 25 - DNA, 22 bp, Artificial sequence
  Single strand DNA oligonucleotide
ccaccactgcatcaaattcatg

SEQ ID NO: 26 - DNA, 86 bp, Artificial sequence
  Human SDHA PCR amplicon
tgggaacaagagggcatctgctaaagtttcagattccatttctgctcagtatccagtagtggatcatgaatttgatgcagtggtgg

SEQ ID NO: 27 - DNA, 21 bp, Artificial sequence
  Single strand DNA oligonucleotide
tgacactggcaaaacaatgca

SEQ ID NO: 28 - DNA, 21 bp, Artificial sequence
  Single strand DNA oligonucleotide
ggtccttttcaccagcaagct

SEQ ID NO: 29 - DNA, 94 bp, Artificial sequence
  hprt1 PCR amplicon
tgacactggcaaaacaatgcagactttgctttccttggtcaggcagtataatccaaagatggtcaaggtcgcaagcttgctggtgaaaaggacc

SEQ ID NO: 30 - DNA, 19 bp, Artificial sequence
  Single strand DNA oligonucleotide
tgagagtgattcgcgtggg

SEQ ID NO: 31 - DNA, 21 bp, Artificial sequence
  Single strand DNA oligonucleotide
ccagggtacgaggctttcaat

SEQ ID NO: 32 - DNA, 91 bp, Artificial sequence
  Human PBGD PCR amplicon
tgagagtgattcgcgtgggtacccgcaagagccagcttgctcgcatacagacggacagtgtggtggcaacattgaaagcctcgtaccctgg

SEQ ID NO: 33 - DNA, 20 bp, Artificial sequence
  Single strand DNA oligonucleotide
tgcaccaccaactgcttagc

SEQ ID NO: 34 - DNA, 19 bp, Artificial sequence
  Single strand DNA oligonucleotide
ccatcacgccacagtttcc

SEQ ID NO: 35 - DNA, 143 bp, Artificial sequence
  GAPDH PCR amplicon
tgcaccaccaactgcttagcacccctggccaaggtcatccatgacaactttggtatcgtggaaggactcatgaccacagtccatgccatcactgccacccagaagactgtggatggcccctccgggaaactgtggcgtgatgg

SEQ ID NO: 36 - DNA, 19 bp, Artificial sequence
  GAPDH PCR amplicon
atttgggtcgcggttcttg

SEQ ID NO: 37 - DNA, 21 bp, Artificial sequence
  GAPDH PCR amplicon
tgccttgacattctcgatggt

SEQ ID NO: 38 - DNA, 133 bp, Artificial sequence
  Ubiquitin PCR amplicon
atttgggtcgcggttcttgtttgtggatcgctgtgatcgtcacttgacaatgcagatcttcgtgaagactctgactggtaagaccatcaccctcgaggttgagcccagtgacaccatcgagaatgtcaaggca

SEQ ID NO: 39 - DNA, 20 bp, Artificial sequence
  GAPDH PCR amplicon
gaggccgtcaccaagaacat

SEQ ID NO: 40 - DNA, 19 bp, Artificial sequence
  GAPDH PCR amplicon
ggacagccggtcagagctc

SEQ ID NO: 41 - DNA, 115 bp, Artificial sequence
  G-6-PD PCR amplicon
ctacgaggccgtcaccaagaacattcacgagtcctgcatgagccagataggctggaaccgcatcatcgtggagaagcccttcgggagggacctgcagagctctgaccggctgtcc

SEQ ID NO: 42 - DNA, 20 bp, Artificial sequence
  GAPDH PCR amplicon
ctggcaagcagctggaagat

SEQ ID NO: 43 - DNA, 23 bp, Artificial sequence
  GAPDH PCR amplicon
tttcttagcaccaccacgaagtc

SEQ ID NO: 44 - DNA, 101 bp, Artificial sequence
  Ribosomal protein S27a (RPS27A) PCR amplicon
ctggcaagcagctggaagatggacgtactttgtctgactacaatattcaaaaggagtctactcttcatcttgtgttgagacttcgtggtggtgctaagaaa

SEQ ID NO: 45 - DNA, 279 bp, Homo sapiens
  misc_feature: Troponin unique region
cctatgggatggggacacgcccaggagctcttgggaggggaggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccag

SEQ ID NO: 46 - DNA, 1357 bp, Homo sapiens
cctatgggatggggacacgcccaggagctcttgggaggggaggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacacccgccctatgggatggggacacgcccaggagctcttgggaggggaggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccag

SEQ ID NO: 47 - DNA, 1111 bp, Homo sapiens
cctatgggatggggacacgcccaggagctcttgggaggggaggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacacccgc

SEQ ID NO: 48 - DNA, 1248 bp, Homo sapiens
cctatgggatggggacacgcccaggagctcttgggaggggaggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagcccccgaagagccggagccggtggcagagccagaagaggaacgccccaaaccaagcccgcctcagctgggaccctccacgttcaggagcctcccggggctggcggctacctcactggacggcacatcccggaggtgggaggtggctcagggaggtcgggccactcatggtctctgtgtttctggccactcagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacacccgc

SEQ ID NO: 49 - DNA, 1043 bp, Homo sapiens
cctatgggatggggacacgcccaggagctcttgggaggggaggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaagaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacacccgc

SEQ ID NO: 50 - DNA, 883 bp, Homo sapiens
cctatgggatggggacacgcccaggagctcttgggaggggaggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagaagaggaacgccccaaaccaagccgccccgtggtgcctcctttgatcccgccaaagatcccagaaggggagcgcgttgacttcgatgaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacacccgc

SEQ ID NO: 51 - DNA, 1206 bp, Homo sapiens
cctatgggatggggacacgcccaggagctcttgggaggggaggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacacccgctgggttctctgatgttattatggttgagatgcagctggtctctcctggttaattgacttcttattaccaacaagttacttgaaagagtgtcaccaataatcattaaagtacggcaggctgaaccttca

SEQ ID NO: 52 - DNA, 1073 bp, Homo sapiens
cctatgggatggggacacgcccaggagctcttgggaggggaggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttactgcgtctcgctctgtcacccaggctggagtgcagtggagtgatctcagctcactgcaacttccatctcccgggttcaagcgattctcctgcctcagccccctgagtagctgggattacaggtgcgcgc

SEQ ID NO: 53 - DNA, 954 bp, Homo sapiens
cctatgggatggggacacgcccaggagctcttgggaggggaggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagaagaggaacgccccaaaccaagcccgcctcagctgggaccctccacgttcaggagcctcccggggctggcggctacctcactggacggcacatcccggaggtgggaggtggctcagggaggtcgggccactcatggtctctgtgtttctggccactcagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcgctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacacccgc

SEQ ID NO: 54 - protein, 90 aa, Homo sapiens
  misc_feature: Troponin unique region
MGTRPGALGRGGEECGTLAGKGRLSPRALARPLRVWSVSSRHPCTARGNVPIAAEARGTPVQQRLEPWSLATAPIPPPAPNAFSSVPPSP

SEQ ID NO: 55 - protein, 326 aa, Homo sapiens
MGTRPGALGRGGEECGTLAGKGRLSPRALARPLRVWSVSSRHPCTARGNVPIAAEARGTPVQQRLEPWSLATAPIPPPAPNAFSSVPPSPEEAAEEEEEEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLKQQKYEINVLYNRISHAQKFRKGAGKGRVGGRWK

SEQ ID NO: 56 - protein, 337 aa, Homo sapiens
MGTRPGALGRGGEECGTLAGKGRLSPRALARPLRVWSVSSRHPCTARGNVPIAAEARGTPVQQRLEPWSLATAPIPPPAPNAFSSVPPSPEEAAEEEEEAPEEPEPVAEPEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLKQQKYEINVLYNRISHAQKFRKGAGKGRVGGRWK

SEQ ID NO: 57 - protein, 170 aa, Homo sapiens
MGTRPGALGRGGEECGTLAGKGRLSPRALARPLRVWSVSSRHPCTARGNVPIAAEARGTPVQQRLEPWSLATAPIPPPAPNAFSSVPPSPEEAAEEEEEAPEEPEPVAEPEEERPKPSPPQLGPSTFRSLPGLAATSLDGTSRRWEVAQGGRATHGLCVSGHSAAPWCLL

SEQ ID NO: 58 - protein, 198 aa, Homo sapiens
MGTRPGALGRGGEECGTLAGKGRLSPRALARPLRVWSVSSRHPCTARGNVPIAAEARGTPVQQRLEPWSLATAPIPPPAPNAFSSVPPSPEEAAEEEEEEEERPKPSRPVVPPLIPPKIPEGERVDFDDIHRKRMEKDLLELQTLIDVHFEQRKKEEEELVALKERIERRRSERAEQQRFRRGEDEEGRGRGQEAGRG

SEQ ID NO: 59 - protein, 261 aa, Homo sapiens
MGTRPGALGRGGEECGTLAGKGRLSPRALARPLRVWSVSSRHPCTARGNVPIAAEARGTPVQQRLEPWSLATAPIPPPAPNAFSSVPPSPEEAAEEEEEEEERPKPSRPVVPPLIPPKIPEGERVDFDEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLKQQKYEINVLYNRISHAQKFRKGAGKGRVGGRWK

SEQ ID NO: 60 - protein, 346 aa, Homo sapiens
MGTRPGALGRGGEECGTLAGKGRLSPRALARPLRVWSVSSRHPCTARGNVPIAAEARGTPVQQRLEPWSLATAPIPPPAPNAFSSVPPSPEEAAEEEEEEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLKQQKYEINVLYNRISHAQKLLRLALSPRLECSGVISAHCNFHLPGSSDSPASAP

SEQ ID NO: 61 - protein, 159 aa, Homo sapiens
MGTRPGALGRGGEECGTLAGKGRLSPRALARPLRVWSVSSRHPCTARGNVPIAAEARGTPVQQRLEPWSLATAPIPPPAPNAFSSVPPSPEEAAEEEEEEEERPKPSPPQLGPSTFRSLPGLAATSLDGTSRRWEVAQGGRATHGLCVSGHSAAPWCLL

SEQ ID NO: 62 - protein, 162 aa, Homo sapiens
MDPQTAPSRALLLLLFLHLAFLGGRSHPLGSPGSASDLETSGLQEQRNHLQGKLSELQVEQTSLEPLQESPRPTGVWKSREVATEGIRGHRKMVLYTLRAPRSPKMVQGSGCFGRKMDRISSSSGLGCKGKHPLPPRPPSPIPVCDTVRVTLGFVVSGNHTL

SEQ ID NO: 63 - DNA, 1254 bp, Homo sapiens
ccccgcaggctgagggcaggtgggaagcaaacccggacgcatcgcagcagcagcagcagcagcagaagcagcagcagcagcctccgcagtccctccagagacatggatccccagacagcaccttcccgggcgctcctgctcctgctcttcttgcatctggctttcctgggaggtcgttcccacccgctgggcagccccggttcagcctcggacttggaaacgtccgggttacaggagcagcgcaaccatttgcagggcaaactgtcggagctgcaggtggagcagacatccctggagcccctccaggagagcccccgtcccacaggtgtctggaagtcccgggaggtagccaccgagggcatccgtgggcaccgcaaaatggtcctctacaccctgcgggcaccacgaagccccaagatggtgcaagggtctggctgctttgggaggaagatggaccggatcagctcctccagtggcctgggctgcaaaggtaagcaccccctgccaccccggccgccttcccccattccagtgtgtgacactgttagagtcactttggggtttgttgtctctgggaaccacactctttgagaaaaggtcacctggacatcgcttcctcttgttaacagccttcagggccaaggggtgcctttgtggaattagtaaatgtgggcttatttcattaccatgcccacaataccttctccccacctcctacttcttatcaaaggggcagaatctcctttgggggtctgtttatcatttggcagccccccagtggtgcagaaagagaaccaaacatttcctcctggtttcctctaaactgtctatagtctcaaaggcagagagcaggatcaccagagcaatgataatccccaatttacagatgaggaaactgaggctcagagagttgcattaagcctcaaacgtctgatgactaacagggtggtgggtggcacacgatgaggtaagctcagcccctgcctccatctcccaccctaaccatcatcaccctctctctttccctgacagtgctgaggcggcattaagaggaagtcctggctgcagacacctgcttctgattccacaaggggctttttcctcaaccctgtggccgcctttgaagtgactcattttttttaatgtatttatgtatttatttgattgttttatataagatggtttcttacctttgagcacaaaatttccacggtgaaataaagtcaacattataagctttatcttttgaaactg

SEQ ID NO: 64 - protein, 33 aa, Homo sapiens
GKHPLPPRPPSPIPVCDTVRVTLGFVVSGNHTL

SEQ ID NO: 65 - protein, 189 aa, Homo sapiens
MIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQSKSGSCLFLHLRW

SEQ ID NO: 66 - DNA, 1061 bp, Homo sapiens
gtgttgagctgttcttggctgacttcacatcaaaactcctatactgacctgagacagaggcagcagtgatacccacctgagagatcctgtgtttgaacaactgcttcccaaaacggaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaagtaagtctggttcttgcctctttcttcacttgagatggtagcaccatctcacgtcctagctggcattagagtcaggtctgcatgccttcccttccctggtgcagatggtgtcatatggtgatcgtgagctgagactatgaagtcagaccctgctgggtttgagtcctagattcaccagttatttattttggcaccttgacaagatagtttaactctctatgtcagttttctcattgtaaaatgaggataataatagtgtgaacttcataggctcatggttacatggtgcctggcacacaggacacattcaataaactgtaattctgtgtccctgcgaggaacatgtactcacctcatctaggtggtaac

SEQ ID NO: 67 - protein, 13 aa, Homo sapiens
  misc_feature: HUMELAM1A_P2 unique region
SKSGSCLFLHLRW

SEQ ID NO: 68 - protein, 257 aa, Homo sapiens
MIFPWKCQSTQRDLWNIFKLWGWTMLCCDFLAHHGTDCWTYHYSEKPMNWQRARRFCRDNYTDLVAIQNKAEIEYLEKTLPFSRSYYWIGIRKIGGIWTWVGTNKSLTEEAENWGDGEPNNKKNKEDCVEIYIKRNKDAGKWNDDACHKLKAALCYTASCQPWSCSGHGECVEIINNYTCNCDVGYYGPQCQFVIQCEPLEAPELGTMDCTHPLGNFSFSSQCAFSCSEGTNLTGIEETTCGPFGNWSSPEPTCQGE

SEQ ID NO: 69 - DNA, 2509 bp, Homo sapiens
aggaggaaggggagggaaaaggggaggaggaggaggatgtgagactgggttagagaaatgaaagaaagcaaggctttctgttgacattcagtgcagtctacctgcagcacagcacactccctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaaggagaataacaactgaaaaacaaaaacacaatctcttgatcttttcaagtttgaaataagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttggcatttatcatttggctggcaaggagattaaaaaaaggcaagaaatccaagagaagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctacctgaccaacagttccttcagcttccatttcgcccctcatttatccctcaacccccagcccacaggtgtttatacagctcagctttttgtcttttctgaggagaaacaaataagaccataaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaagtctacgctctcctttctttctaactccagtgaagtaatggggtcctgctcaagttgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagaccttttatccacttacctagattctacatattctttaaatttcatctcaggcctccctcaaccccaccacttcttttataactagtcctttactaatccaacccatgatgagctcctcttcctggcttcttactgaaaggttaccctgtaacatgcaattttgcatttgaataaagcctgctttttaagtgttaaaaaaaaaaaa

SEQ ID NO: 70 - protein, 2 aa, Homo sapiens
  misc_feature: MMPLNHR_P2 unique region
GE

SEQ ID NO: 71 - protein, 329 aa, Homo sapiens
MIFPWKCQSTQRDLWNIFKLWGWTMLCCDFLAHHGTDCWTYHYSEKPMNWQRARRFCRDNYTDLVAIQNKAEIEYLEKTLPFSRSYYWIGIRKIGGIWTWVGTNKSLTEEAENWGDGEPNNKKNKEDCVEIYIKRNKDAGKWNDDACHKLKAALCYTASCQPWSCSGHGECVEIINNYTCNCDVGYYGPQCQFVIQCEPLEAPELGTMDCTHPLGNFSFSSQCAFSCSEGTNLTGIEETTCGPFGNWSSPEPTCQVIQCEPLSAPDLGIMNCSHPLASFSFTSACTFICSEGTELIGKKKTICESSGIWSNPSPICQSKKSKRSMNDPY

SEQ ID NO: 72 - DNA, 2321 bp, Homo sapiens
aggaggaaggggagggaaaaggggaggaggaggaggatgtgagactgggttagagaaatgaaagaaagcaaggctttctgttgacattcagtgcagtctacctgcagcacagcacactccctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaagcaagaaatccaagagaagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctacctgaccaacagttccttcagcttccatttcgcccctcatttatccctcaacccccagcccacaggtgtttatacagctcagctttttgtcttttctgaggagaaacaaataagaccataaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaagtctacgctctcctttctttctaactccagtgaagtaatggggtcctgctcaagttgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagaccttttatccacttacctagattctacatattctttaaatttcatctcaggcctccctcaaccccaccacttcttttataactagtcctttactaatccaacccatgatgagctcctcttcctggcttcttactgaaaggttaccctgtaacatgcaattttgcatttgaataaagcctgctttttaagtgttaaaaaaaaaaaa

SEQ ID NO: 73 - protein, 3 aa, Homo sapiens
  misc_feature: MMPLNHR_P3 unique region
QSK

SEQ ID NO: 74 - protein, 319 aa, Homo sapiens
MIFPWKCQSTQRDLWNIFKLWGWTMLCCDFLAHHGTDCWTYHYSEKPMNWQRARRFCRDNYTDLVAIQNKAEIEYLEKTLPFSRSYYWIGIRKIGGIWTWVGTNKSLTEEAENWGDGEPNNKKNKEDCVEIYIKRNKDAGKWNDDACHKLKAALCYTASCQPWSCSGHGECVEIINNYTCNCDVGYYGPQCQFVIQCEPLEAPELGTMDCTHPLGNFSFSSQCAFSCSEGTNLTGIEETTCGPFGNWSSPEPTCQVIQCEPLSAPDLGIMNCSHPLASFSFTSACTFICSEGTELIGKKKTICESSGIWSNPSPICQSE

SEQ ID NO: 75 - DNA, 1772 bp, Homo sapiens
aggaggaaggggagggaaaaggggaggaggaggaggatgtgagactgggttagagaaatgaaagaaagcaaggctttctgttgacattcagtgcagtctacctgcagcacagcacactccctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaagtgagtaagtttgtcctggaaaactgaaatcttaacgatggagctgatggatgagcagatatgaggaaagacatacataaacatttacatgttgttttgctaagaatatgtggcctagaaataaatttgtatgcttaactcactgtaaaatctttggctggtctttcctcctcctttaatgacaatcatttcctttttttgttctcacctcttgccatcttaactcctaaaatctgaactcactgatttactttttacccattcttctattccactacaatctaacatctctgttagcccattgaaatgcctgtaaaaggtcactaatgaccacctacttccccaaataatggatactcctgaatcatcactaagctaatgcctccaaaatctatctgtatatgagaagaatcatgtcttgttcatctttgtataccctccacctgacacagtgcctggcaataggtgctaaagcaaatgcatgttaagctagcatgtgaaagaatagctacctgtgtctgctcctgagactatctgcatggatgacaaaagtctttaaatggtaggatctacagaagctgtcagaaatgctgatctctgtgtgctgcgtgcccag

SEQ ID NO: 76 - protein, 2 aa, Homo sapiens
  misc_feature: MMPLNHR_P6 unique region
SE

SEQ ID NO: 77 - protein, 317 aa, Homo sapiens
MALRVLLLTALTLCHGFNLDTENAMTFQENARGFGQSVVQLQGSRVVVGAPQEIVAANQRGSLYQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGNAALRLMLLWRVSMWIHPPFNLQILLKSK

SEQ ID NO: 78 - DNA, 1125 bp, Homo sapiens
tygttttctgcccttctttgctttggtggcttccttgtggttcctcagtggtgcctgcaacccctggttcacctccttccaggttctggctccttccagccatggctctcagagtccttctgttaacagccttgaccttatgtcatgggttcaacttggacactgaaaacgcaatgaccttccaagagaacgcaaggggcttcgggcagagcgtggtccagcttcagggatccagggtggtggttggagccccccaggagatagtggctgccaaccaaaggggcagcctctaccagtgcgactacagcacaggctcatgcgagcccatccgcctgcaggtccccgtggaggccgtgaacatgtccctgggcctgtccctggcagccaccaccagcccccctcagctgctggcctgtggtcccaccgtgcaccagacttgcagtgagaacacgtatgtgaaagggctctgcttcctgtttggatccaacctacggcagcagccccagaagttcccagaggccctccgagggtgtcctcaagaggatagtgacattgccttcttgattgatggctctggtagcatcatcccacatgactttcggcggatgaaggagtttgtctcaactgtgatggagcaattaaaaaagtccaaaaccttgttctctttgatgcagtactctgaagaattccggattcactttaccttcaaagagttccagaacaaccctaacccaagatcactggtgaagccaataacgcagctgcttgggcggacacacacggccacgggcatccgcaaagtggtacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtagggaatgcagctctcaggttgatgcttctgtggagggtttctatgtggatccatcctcccttcaatttgcaaatattattaaaatcaaagtgacatgagagctaatgctagctcatatacaccgtatcagctatctgttgccacatcaatgctgtgtaataaa

SEQ ID NO: 79 - protein, 29 aa, Homo sapiens
  misc_feature: HUMLAPA_P8 unique region
NAALRLMLLWRVSMWIHPPFNLQILLKSK

SEQ ID NO: 80 - protein, 750 aa, Homo sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILACDPGLSRTCDQNTYLSGLCYLFRQNLQGPMLQGRPGFQECIKGNVDLVFLFDGSMSLQPDEFQKILDFMKDVMKKLSNTSYQFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAVRRDG

SEQ ID NO: 81 - DNA, 2842 bp, Homo sapiens
gagtgtcaccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttggcctgtgaccctgggctgtctcgaacgtgtgaccagaacacctatctgagtggcctgtgttacctcttccgccagaatctgcagggtcccatgctgcaggggcgccctggttttcaggaatgtatcaagggcaacgtagacctggtatttctgtttgatggttcgatgagcttgcagccagatgaatttcagaaaattctggacttcatgaaggatgtgatgaagaaactcagcaacacttcgtaccagtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcggtaagaagagatggctagggatggtggggagtttatcagagaaatccatttggcaagaagagccgcccatggccgggcagcacactcctataatcccagcactttgggaggctgaagtgggtggatcacttaaggtcaggggttcaggaccagcctggccaacatggtgaaaccccatctctactaaaaatacaaagattagtcgggtgtgatggtgcacttgaggccaggagtttgagaccagcctgggcaacatagtgggactccctttctacaaaacataaaaaattagttattgtgatggtgcgcccctgtagtcccagctacttgggaggctgagcagggaggatcacttgagccagagggttgaggctgcagtgagctattgagctatgattgcaccactgccctccagcctaggcaacagcacgaaaccctgtctctaaagaag

SEQ ID NO: 82 - protein, 5 aa, Homo sapiens
VRRDG

SEQ ID NO: 83 - protein, 1000 aa, Homo sapiens
MARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRDETRNVGSQTLQTFKARQGLGASVVSWSDVIVACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRAEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQRPLDQFVLQSHAWFNVSSLPYAVPPLSLPRGEAQVGFFKRNRPPLEEDDEEGE

SEQ ID NO: 84 - DNA, 3329 bp, Homo sapiens
ggctatagccctttgctctgcccgttgctcagcaagttacttggggttccagtttgataagaaaagacttcctgtggaggaatctgaagggaaggaggaggagctggcccattcctgcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggagagtggccatcgtggtgggcgccccgcggaccctgggccccagccaggaggagacgggcggcgtgttcctgtgcccctggagggccgagggcggccagtgcccctcgctgctctttgacctccgtgatgagacccgaaatgtaggctcccaaactttacaaaccttcaaggcccgccaaggactgggggcgtcggtcgtcagctggagcgacgtcattgtggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagctgggacaagcgttactgtgaagcgggcttcagctccgtggtcactcaggccggagagctggtgcttggggctcctggcggctattatttcttaggtctcctggcccaggctccagttgcggatattttctcgagttaccgcccaggcatccttttgtggcacgtgtcctcccagagcctctcctttgactccagcaacccagagtacttcgacggctactgggggtactcggtggccgtgggcgagttcgacggggatctcaacactacagaatatgtcgtcggtgcccccacttggagctggaccctgggagcggtggaaattttggattcctactaccagaggctgcatcggctgcgcgcagagcagatggcgtcgtattttgggcattcagtggctgtcactgacgtcaacggggatgggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatgacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccagacctgatcgtgggagcttacggggccaaccaggtggctgtgtacagagctcagccagtggtgaaggcctctgtccagctactggtgcaagattcactgaatcctgctgtgaagagctgtgtcctacctcagaccaagacacccgtgagctgcttcaacatccagatgtgtgttggagccactgggcacaacattcctcagaagctatccctaaatgccgagctgcagctggaccggcagaagccccgccagggccggcgggtgctgctgctgggctctcaacaggcaggcaccaccctgaacctggatctgggcggaaagcacagccccatctgccacaccaccatggccttccttcgagatgaggcagacttccgggacaagctgagccccattgtgctcagcctcaatgtgtccctaccgcccacggaggctggaatggcccctgctgtcgtgctgcatggagacacccatgtgcaggagcagacacgaatcgtcctggactgtggggaagatgacgtatgtgtgccccagcttcagctcactgccagcgtgacgggctccccgctcctagttggggcagataatgtcctggagctgcagatggacgcagccaacgagggcgagggggcctatgaagcagagctggccgtgcacctgccccagggcgcccactacatgcgggccctaagcaatgtcgagggctttgagagactcatctgtaatcagaagaaggagaatgagaccagggtggtgctgtgtgagctgggcaaccccatgaagaagaacgcccagataggaatcgcgatgttggtgagcgtggggaatctggaagaggctggggagtctgtgtccttccagctgcagatacggagcaagaacagccagaatccaaacagcaagattgtgctgctggacgtgccggtccgggcagaggcccaagtggagctgcgagggaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtggactgggggctgcccatccccagcccctcccccattcacccggcccatcacaagcgggatcgcagacagatcttcctgccagagcccgagcagccctcgaggcttcaggatccagttctcgtaagctgcgactcggcgccctgtactgtggtgcagtgtgacctgcaggagatggcgcgcgggcagcgggccatggtcacggtgctggccttcctgtggctgcccagcctctaccagaggcctctggatcagtttgtgctgcagtcgcacgcatggttcaacgtgtcctccctcccctatgcggtgcccccgctcagcctgccccgaggggaagctcaggtcggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccctgat

SEQ ID NO: 85 - protein, 269 aa, Homo sapiens
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 86 - protein, 886 aa, Homo sapiens
MARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRDETRNVGSQTLQTFKARQGLGASVVSWSDVIVACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRAEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVGFFKRNRPPLEEDDEEGE

SEQ ID NO: 87 - DNA, 2987 bp, Homo sapiens
ggctatagccctttgctctgcccgttgctcagcaagttacttggggttccagtttgataagaaaagacttcctgtggaggaatctgaagggaaggaggaggagctggcccattcctgcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggagagtggccatcgtggtgggcgccccgcggaccctgggccccagccaggaggagacgggcggcgtgttcctgtgcccctggagggccgagggcggccagtgcccctcgctgctctttgacctccgtgatgagacccgaaatgtaggctcccaaactttacaaaccttcaaggcccgccaaggactgggggcgtcggtcgtcagctggagcgacgtcattgtggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagctgggacaagcgttactgtgaagcgggcttcagctccgtggtcactcaggccggagagctggtgcttggggctcctggcggctattatttcttaggtctcctggcccaggctccagttgcggatattttctcgagttaccgcccaggcatccttttgtggcacgtgtcctcccagagcctctcctttgactccagcaacccagagtacttcgacggctactgggggtactcggtggccgtgggcgagttcgacggggatctcaacactacagaatatgtcgtcggtgcccccacttggagctggaccctgggagcggtggaaattttggattcctactaccagaggctgcatcggctgcgcgcagagcagatggcgtcgtattttgggcattcagtggctgtcactgacgtcaacggggatgggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatgacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccagacctgatcgtgggagcttacggggccaaccaggtggctgtgtacagagctcagccagtggtgaaggcctctgtccagctactggtgcaagattcactgaatcctgctgtgaagagctgtgtcctacctcagaccaagacacccgtgagctgcttcaacatccagatgtgtgttggagccactgggcacaacattcctcagaagctatccctaaatgccgagctgcagctggaccggcagaagccccgccagggccggcgggtgctgctgctgggctctcaacaggcaggcaccaccctgaacctggatctgggcggaaagcacagccccatctgccacaccaccatggccttccttcgagatgaggcagacttccgggacaagctgagccccattgtgctcagcctcaatgtgtccctaccgcccacggaggctggaatggcccctgctgtcgtgctgcatggagacacccatgtgcaggagcagacacgaatcgtcctggactgtggggaagatgacgtatgtgtgccccagcttcagctcactgccagcgtgacgggctccccgctcctagttggggcagataatgtcctggagctgcagatggacgcagccaacgagggcgagggggcctatgaagcagagctggccgtgcacctgccccagggcgcccactacatgcgggccctaagcaatgtcgagggctttgagagactcatctgtaatcagaagaaggagaatgagaccagggtggtgctgtgtgagctgggcaaccccatgaagaagaacgcccagataggaatcgcgatgttggtgagcgtggggaatctggaagaggctggggagtctgtgtccttccagctgcagatacggagcaagaacagccagaatccaaacagcaagattgtgctgctggacgtgccggtccgggcagaggcccaagtggagctgcgagggaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtcggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccctgat

SEQ ID NO: 88 - protein, 103 aa, Homo sapiens
  misc_feature: T11329_P2 unique region
MHKKGSPILGSHTARVAGTSPPALPLLAQLPDASAEPHGPRHALRRPQQSPAPAGGAAAPAPGGRQPARSRWVPAPWGPRAGRGWGGRPAPTAPLNQRVYSSL

SEQ ID NO: 89 - protein, 228 aa, Homo sapiens
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGEPSAASRPVSPCLFNHCPSLCQHPGLTRAPTCPPSC

SEQ ID NO: 90 - DNA, 915 bp, Homo sapiens
cacttcctcctctgccgtctcccagatcagtacacaaaggctgctgctgccgccagaggaaggactgctctgcacgcacctatgtggaaactaaagcccagagagaaagtctgacttgccccacagccagtgagtgactgcagcagcaccagaatctggtctgtttcctgtttggctcttctaccactacggcttgggatctcgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggtgagccgagcgctgcctcccgccctgttagcccttgcctattcaaccactgccctagcctctgccaacatcctggactcacaagggccccaacttgccctcccagttgttgacaggcctagccaggccacagg

SEQ ID NO: 91 - protein, 36 aa, Homo sapiens
  misc_feature: S80335_P5 unique region
EPSAASRPVSPCLFNHCPSLCQHPGLTRAPTCPPSC

SEQ ID NO: 92 - protein, 240 aa, Homo sapiens
MEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRGPTSPYCHIGDEVST

SEQ ID NO: 93 - DNA, 4137 bp, Homo sapiens
gaagagggagcgaaggaggcggggactgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtggtccaacctctccatactgccacattggggatgaagtttcaacatgagtttgggagaagataaacattcaaatcatagcaggaacccaggccatctgactctaagtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtca

SEQ ID NO: 94 - protein, 15 aa, Homo sapiens
  misc_feature: Z40355_P2 unique region
GPTSPYCHIGDEVST

SEQ ID NO: 95 - protein, 622 aa, Homo sapiens
MWCIVLFSLLAWVYAEPTMYGEILSPNYPQAYPSEVEKSWDIEVPEGYGIHLYFTHLDIELSENYINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 96 - DNA, 2590 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 97 - protein, 32 aa, Homo sapiens
  misc_feature: HUMC1RS_P5 unique region
GLNSDLPESSSVRWQYHCAVGCQGRGEPPQPH

SEQ ID NO: 98 - protein, 455 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPGLNSDLPESSSVRWQYHCAVGCQGRGEPPQPH

SEQ ID NO: 99 - DNA, 3003 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccaggactgaacagtgacctgccagagtccagctcagtgaggtggcagtatcactgtgccgtgggctgccagggccgtggggaacctcctcagccgcactgaagccaggccaactggaaggaaatagaaacgtcagccagcgacagttggtgtctggtaatgtagctgcagtgagaagatacagaactgctaaaaacagggcctgaaagctgagagtgttctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 100 - protein, 1 aa, Homo sapiens
  misc_feature: HUMC1RS_P6 unique region
Y

SEQ ID NO: 101 - protein, 902 aa, Homo sapiens
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGVGISNTGICVADTVKAKVFKDVFLEMNIPYSVVRGEQIQLKGTVYNYRTSGMQSLALSPRLECNGKISGQLQVRLPGSSDSPASASQVAGITGTHHHAQPT

SEQ ID NO: 102 - DNA, 2990 bp, Homo sapiens
atatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaactttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaacactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcgttggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagagtctcgccctgtcgcccaggctggagtgcaatgggaagatctcgggtcaactgcaagtccgcctgccaggttcaagcgattctcctgcctcagcctcccaagtagctgggattacaggcacacaccaccatgcccagccaacttgacagcattttaaagtgtcatgcatatcactatactgccatattttatttaatctttaaattttcagtgcatttccatcatatcaaaataagaaacaagtacatctgtgatattttgggcttagttcctgttaattacctttcctcctgagtgtgggttacactttcctatttctttttatctagtaattttggattgaatcttctactttattaataaaaatattataaagactctggattctattacatt

SEQ ID NO: 103 - protein, 48 aa, Homo sapiens
  misc_feature: HUMC5_P6 unique region
SLALSPRLECNGKISGQLQVRLPGSSDSPASASQVAGITGTHHHAQPT

SEQ ID NO: 104 - protein, 297 aa, Homo sapiens
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLRAEVR

SEQ ID NO: 105 - DNA, 1112 bp, Homo sapiens
atatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaactttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttaagggcggaagtacgctgagaggcctataaagatgaatgatgacgcaggaattggaagaagtcgtgtttgtcagctattaccaaaaagacctgttggaccatgtgatgttcaagacccttctacttctataattctatacaaataattagaaaataacatcctgggcttaatcgtggactcggttatctactttacttttgacact

SEQ ID NO: 106 - protein, 5 aa, Homo sapiens
  misc_feature: HUMC5_P7 unique region
RAEVR

SEQ ID NO: 107 - protein, 182 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDSELKYPFLFLLPTHSNFSLE

SEQ ID NO: 108 - DNA, 676 bp, Homo sapiens
acactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgagtttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagtgagttgaaatatcccttcctatttcttttaccgacacattctaatttttctctggaataataaaaatcttaactga

SEQ ID NO: 109 - protein, 20 aa, Homo sapiens
  misc_feature: HSCR1RS_P6 unique region
SELKYPFLFLLPTHSNFSLE

SEQ ID NO: 110 - protein, 703 aa, Homo sapiens
MFPTESAWLGKRGANPAPEAAVRETVMLLLCLGVPTGRPYNVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVTCGHRWKNIFYIKNENKLPTGGCYGVPPDLRTELSKRIAPCYQDYVKKFGENFASCQAGISSFYTKDLIVMGAPGSSYWTGSLFVYNITTNKYKAFLDKQNQVKFGSYLGYSVGAGHFRSQHTTEVVGGAPQHEQIGKAYIFSIDEKELNILHEMKGKKLGSYFGASVCAVDLNADGFSDLLVGAPMQSTIREEGRVFVYINSGSGAVMNAMETNLVGSDKYAARFGESIVNLGDIDNDGFEDVAIGAPQEDDLQGAIYIYNGRADGISSTFSQRIEGLQISKSLSMFGQSISGQIDADNNGYVDVAVGAFRSDSAVLLRTRPVVIVDASLSHPESVNRTKFDCVENGWPSVCIDLTLCFSYKGKEVPGYIVLFYNMSLDVNRKAESPPRFYFSSNGTSDVITGSIQVSSREANCRTHQAFMRKDVRDILTPIQIEAAYHLGPHVISKRSTEEFPPLQPILQQKKEKDIMKKTINFARFCAHENCSADLQVSAKIGFLKPHENKTYLAVGSMKTLMLNVSLFNAGDDAYETTLHVKLPVGLYFIKILELLFHFSH

SEQ ID NO: 111 - DNA, 6502 bp, Homo sapiens
ggcagggcacacctggattgcattagaatgagactcactacccagttcaggtgtgttgcgttgtgggtctccggcacatttcagaggctsattaggaccctgaccccacactggggtttacacccctaaaagcaggtgtgtcccgtggcaactgagtgggtgcgtgaaaaggggggatcatcaattaccagctggagcaatcgaatcggttaaagtgaatcaagtcacagtgcttccttaacccaacctctctgttggggtcagccacagcctaaaccgcctgccgttcagcctgagaggctgctgctagcctgctcacgcatgcagcccgggctgcagaggaagtgtggggaggaaggaagtgggtatagaagggtgctgagatgtgggtcttgaagagaatagccataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggtcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctcggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgcttagtgttgaatgttccccaccgagagcgcatggcttgggaagcgaggcgcgaacccggcccccgaagccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctgttgtttcatttttcccattaggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccggttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaatgacttctggataattatttttttataattatggatttcaccatctttctttctgtatatatacatgtgtttttatgtaggtatatatttaccattcttcctatctattcttcctataacacacctttatcaagcatacccaggagtaatcttcaaatcttttgttatattctgaaacaaaagattgtgagtgttgcactttacctgatacacgctgatttagaaaatacagaaaccatacctcactaataactttaaaatcaaagctgtgcaaagactagggggcctatacttcatatgtattatgtactatgtaaaatattgactatcacacaactatttccttggatgtaattctttgttaccctttacaagtataagtgttaccttacatggaaacgaagaaacaaaattcataaatttaaattcataaatttagctgaaagatactgattcaatttgtatacagtgaatataaatgagacgacagcaaaattttcatgaaatgtaaaatatttttatagtttgttcatactatatgaggttctattttaaatgactttctggattttaaaaaatttctttaaatacaatcatttttgtaatatttattttatgcttatgatctagataattgcagaatatcattttatctgactctgtcttcataagagagctgtggccgaattttgaacatctgttatagggagtgatcaaattagaaggcaatgtggaaaaacaattctgggaaagatttctttatatgaagtccctgccactagccagccatcctaattgatgaaagttatctgttcacaggcctgcagtgatggtgaggaatgttctgagatttgcgaaggcatttgagtagtgaaatgtaagcacaaaacctcctgaacccagagtgtgtatacacaggaataaactttatgacatttatgtatttttaaaaaactttgtatcgttataaaaaggctagtcattctttcaggagaacatctaggatcatagatgaaaaatcaagccccgatttagaactgtcttctccaggatggtctctaaggaaatttacatttggttctttcctactcagaactactcagaaacaactatatatttcaggttatttgagcacagtgaaagcagagtactatggttgtccaacacaggcctctcagatacaaggggaacacaattacatattgggctagattttgcccagttcaaaatagtatttgttatcaacttactttgttacttgtatcatgaattttaaaaccctaccactttaagaagacagggatgggttattcttttttggcaggtaggctatataactatgtgattttgaaatttaactgctctggattagggagcagtgaatcaaggcagacttatgaaatctgtattatatttgtaacagaatataggaaatttaacataattgatgagctcaaatcctgaaaaatgaaagaatccaaattatttcagaattatctaggttaaatattgatgtattatgatggttgcaaagtttttttgtgtgtccaataaacacattgta

SEQ ID NO: 112 - protein, 6 aa, Homo sapiens
  misc_feature: HSINTAL4_P2 unique region
LFHFSH

SEQ ID NO: 113 - protein, 482 aa, Homo sapiens [sequence omitted]

SEQ ID NO: 114 - DNA, 3037 bp, Homo sapiens
ataaaaacaggcctgcctcagctccctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgccaggcacagtggcacatgcctgaagtcccagctctgggaagctgaggcaggaggatctcttgagcctggtgggtcaaggctgcagtgaaccatgttcatgccactgcactccagtctggatgacagagcgagacctagtctcaaaaaaaaaaaaaaaaaaaagaaagaagaaagaagaaaggaaaaagaaaaaaaggcagcgggggcgcggtggctcacgcctgtaatcccaccactttgggaggccaaggcgagcggatcacgaggtcaggagatcgagaccatcctggctaacacggtgaaaccccgtctctactaaaaatacaaaaattagccgggcgtggtggcaggcgcctgtagtcccagctactcaggaggctgagacatgagaatggcatgaacccgggaggcggagcttgtagtgagccgagatcacaccactgcactccagcctgggcgacagagcgagactccatcttaaaagaaaaaaaaaaaaaggacatgctacagcatggatgcaccttgaagacatttgcaaagtgaaacaaaccagtcgcaaaagaagaaacactgtctcattccacttctaggataatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcactacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 115 - protein, 208 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRTPVPRHWAWANIITAGILMGMPSPGATC

SEQ ID NO: 116 - DNA, 2466 bp, Homo sapiens
ataaaaacaggcctgcctcagctccctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 117 - protein, 28 aa, Homo sapiens
  misc_feature: HUMUPAA_X24 unique region
TPVPRHWAWANIITAGILMGMPSPGATC

SEQ ID NO: 118 - protein, 326 aa, Homo sapiens
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQVRFLMLVGGSTLCVRRAPPTTAVPSRTSLVLTLNELPNRTSGLLETNFTASARTTGSGLLKWQQGFRAKIPGLLNQTSRSLDQIPGYLNRIHELLNGTRGLFPGPSRRTLGAPDISSGTSDTGSLPPNLQPGYSPSPTHPPTGQYTLFPLPPTLPTPVVQLHPLLPDPSAPTPTPTSPLLNTSYTHSQNLSQEG

SEQ ID NO: 119 - DNA, 1780 bp, Homo sapiens
tcttcctacccatctgctccccagagggctgcctgctgtgcacttgggtcctggagcccttctccacccggatagattcctcacccttggcccgcctttgccccaccctactctgcccagaagtgcaagagcctaagccgcctccatggccccaggaaggattcaggggagaggccccaaacagggagccacgccagccagacaccccggccagaatggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccaggtgcgtttcctgatgcttgtaggagggtccaccctctgcgtcaggcgggccccacccaccacagctgtccccagcagaacctctctagtcctcacactgaacgagctcccaaacaggacttctggattgttggagacaaacttcactgcctcagccagaactactggctctgggcttctgaagtggcagcagggattcagagccaagattcctggtctgctgaaccaaacctccaggtccctggaccaaatccccggatacctgaacaggatacacgaactcttgaatggaactcgtggactctttcctggaccctcacgcaggaccctaggagccccggacatttcctcaggaacatcagacacaggctccctgccacccaacctccagcctggatattctccttccccaacccatcctcctactggacagtatacgctcttccctcttccacccaccttgcccacccctgtggtccagctccaccccctgcttcctgacccttctgctccaacgcccacccctaccagccctcttctaaacacatcctacacccactcccagaatctgtctcaggaagggtaaggttctcagacactgccgacatcagcattgtctcgtgtacagctcccttccctgcagggcgcccctgggagacaactggacaagatttcctactttctcctgaaacccaaagccctggtaaaagggatacacaggactgaaaagggaatcatttttcactgtacattataaaccttcagaagctatttttttaagctatcagcaatactcatcagagcagctagctctttggtctattttctgcagaaatttgcaactcactgattctctacatgctctttttctgtgataactctgcaaaggcctgggctggcctggcagttgaacagagggagagactaaccttgagtcagaaaacagagaaagggtaatttcctttgcttcaaattcaaggccttccaacgcccccatcccctttactatcattctcagtgggactctgatcccatattcttaacagatctttactcttgagaaatgaataagctttctctcagaaatgctgtccctatacactagacaaaactgagcctgtataaggaataaatgggagcgccgaaaagctccctaaaaagcaagggaaa

SEQ ID NO: 120 - protein, 156 aa, Homo sapiens
MTSSLQRPWRVPWLPWTILLVSTAAASQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLKTGFHRVSQDGLDLLTS

SEQ ID NO: 121 - DNA, 1955 bp, Homo sapiens
gcctcccggagggacgcagggtgtctcgccgcctccctgcccacccccttccccggctaccttcatccgccctcccgccgccccccgccctcggtccgcgacgcccgagttccgtcaggagcccagagctgcgggagaacgaggcggcggcggcggcggcggcggcggcggcggcggcagcagcagcggcttcctcggggggttgtgattcgctcacaggagccattgacgggagaagaggaggctttcttggtggaatttacctcaggcaagatcgagccgcaggaataaaaagcgaggaagggaagggagcgccgccgggaggactagaaggggcagcctctcacacccactccgcctgccgtctcggggagcccggaccggggccgcgaccgcgacccctcccctcccccgctcctacctctcctcagccttcgccagggcctccccaaccctctcacggttgttctgcgaaggcgtggggactgtgagcttgtccatggaggcaggcaccttttttgatccagtcaaggaagaggatttgttgttttcgaaatcagagtgaaggaagcaccgaagcgaaacttaaggaatcctgccttcccggagccgcgggcgatgcgactagggctgccgggcgccgccgccgcccgtccggcttcgtccttcccggcagtcgggaactagttctgaccctcgccccccgaccccggatcgaatccccgccctccgcaccctggatatgttttctcccagacctggatatttttttgatatcgtgaaactacgagggaaataatttgggggatttcttcttggctccctgctttccccacagacatgccttccgtttggagggccgcggcaccccgtccgaggcgaaggaacccccccagccgcgagggagagaaatgaagggaatttctgcagcggcatgaaagctctgcagctaggtcctctcatcagccatttgtcctttcaaactgtattgtgatacgggcaggatcagtccacgggagagaagacgagcctcccggctgtttctccgccggtctacttcccatatttcttttctttgccctcctgattcttggctggcccagggatgacttcctcgctgcagcggccctggcgggtgccctggctaccatggaccatcctgctggtcagcactgcggctgcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcaagacggggtttcaccgtgttagccaggatggtctcgatctcctgacctcatgatccgcccgcctcggcctcccaaagtgctgggattacaggcgtgagccaccgcgcctgctggaaaggtcacttattattcctatagttttgtattgtttgaatctttaatttaaaatgagaatatattcatgtattatttgtgtaaccaataacctgcttgtttatttggaaaaagagaaaaatgacataagtagcaaggaaaaaaataatctccaatagtctctacacccatatacaaccattgttaatatttagaatgtttctttccagtcttttctcttttatttttgcgtagctgtatttgtaatatacatccattttagatcctgcctttttgtttaacataaatattttccaggttactatatatgtttcatag

SEQ ID NO: 122 - protein, 431 aa, Homo sapiens
MALPSLLLLVAALAGGVRPPGARNLTLAVVLPEHNLSYAWAWPRVGPAVALAVEALGRALPVDLRFVSSELEGACSEYLAPLSAVDLKLYHDPDLLLGPGCVYPAASVARFASHWRLPLLTAGAVASGFSAKNDHYRTLVRTGPSAPKLGEFVVTLHGHFNWTARAALLYLDARTDDRPHYFTIEGVFEALQGSNLSVQHQVYAREPGGPEQATHFIRANGRIVYICGPLEMLHEILLQAQRENLTNGDYVFFYLDVFGESLRAGPTRATGRPWQDNRTREQAQALREAFQTVLVITYREPPNPEYQEFQNRLLIRAREDFGVELGPSLMNLIAGCFYDGILLYAEVLNETIQEGGTREDGLRIVEKMQGRRYHGVTGLVVMDKNNDRETDFVLWAMGDLDSGDFQLHFQPWQLWLWAQESPSSCLVFPAS

SEQ ID NO: 123 - DNA, 3973 bp, Homo sapiens
cggccacataagatattatctacacaaaagcttatttaggaatgaccaatgagctcaacttaaatttattagaaatctgattagcattataaatcaactgacttttaggagcataggctttggcgctacagggatctggcttgaacctcattgaggccactgattggtgagtgaccttaagcaagtctctttaccttgttagggcacaatttcctctcggaattgtgaaatgggtttaattacaccagcttacatcccaaccatcagcaagtcctcttgtatgtaaccatctccaacacagaaaggggatctgcccatgttctaccatcctcacctttctccaagccactacaacctctcacaacagccttccaattggtctccctaaactcttatcccccctacaccccgttctcagtcctcagtccttgccctaggctggtagcccactccttgcccgccccccgccttcctcccatctccccctcctctccccggcccccagcaccttctgcatcccagcctacctagcctactcctcctcttcctggccctcttccccaggctccaggctggggggtgctcgcgtctcccctgtaggccagagcagccccaagttctgggggcggtggggctgctgctttatccccatggcgctgccatcacttctgctgttggtggcagccctggcaggtggggtgcgtcctcccggggcgcggaacctgacgctggcggtggtgctgccagaacacaacctgagctatgcctgggcctggccacgggtgggacccgctgtggcactagctgtggaggctctgggccgggcactgcccgtggacctgcggtttgtcagctccgaactggaaggcgcctgctctgagtacctggcaccgctgagcgctgtggacctcaagctgtaccatgaccccgacctgctgttaggtcccggttgcgtgtaccctgctgcctctgtggcccgctttgcctcccactggcgccttcccctgctgactgcgggtgctgtggcctctggtttttcggctaagaatgaccattatcgtaccctggttcgcactggcccctctgctcccaagctgggtgagtttgtggtgacactacacgggcacttcaattggactgcccgtgctgccttgctgtacctggatgctcgcacagatgaccggcctcactacttcaccatcgagggcgtctttgaggccctgcagggcagcaacctcagtgtgcagcaccaggtgtatgcccgagagccagggggccccgagcaggccacccacttcatccgggccaacgggcgcattgtgtatatctgcggccctctggagatgctgcatgagatcctgcttcaggcccagagggagaatctgaccaatggggattatgtcttcttttacctggatgtctttggggagagtctccgtgcaggccccacacgtgctacaggccggccctggcaggacaatcgcacccgggaacaggcccaggccctcagagaggcctttcagactgtattggtgatcacgtaccgagaacccccaaatcctgagtatcaggaattccagaatcgtctgctgataagagcccgggaagactttggtgtggagctgggcccttccctgatgaacctcatcgctggctgcttctatgatgggatcctgctatatgctgaagtcctgaatgagacaatacaggaaggaggcacccgggaggatggacttcgaattgtggaaaagatgcagggacgaagatatcacggtgtaactgggctggttgtcatggacaagaacaatgaccgagagactgactttgtcctctgggccatgggagacctggattctggggactttcagctccactttcaaccctggcaattgtggctctgggcacaggaatcaccttcatcatgtttggtgtttccagcttcctaattttccgaaagctgatgctggagaaggagctggctagcatgttgtggcgtattcgctgggaagaactgcagtttggcaactcagagcgttatcacaaaggtgcaggcagtcgcctcacactgtcgctgcggggatccagttacggctcgctcatgacagcccatgggaaataccagatctttgccaacaccggtcacttcaagggaaatgttgtcgccatcaaacatgtgaataagaagcgcattgagctgacccggcaggttctgtttgaactcaaacatatgagagatgttcagttcaaccatctcactcgcttcattggcgcctgcatagaccctcccaacatttgcattgtcactgaatactgtcctcgtgggagtttacaggatattctagaaaatgacagcatcaacttggactggatgtttcgttattcactcattaatgaccttgttaagggcatggcctttctccacaacagcattatttcatcgcatgggagtctcaagtcctccaactgtgtggtggatagtcgttttgtgctcaaaatcacagactatggcctggccagcttccgatcaactgctgaacctgatgacagccatgccctctatgccaagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaaggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccattcagtggcagagcagttaaaacggggagagactgtacaggctgaggcctttgacagtgttaccatctacttcagtgacattgttggcttcacagcattgtcagcagagagcacccccatgcaggtagtgacacttcttaatgacctgtatacctgctttgatgccataattgacaactttgatgtctacaaggtggagacgattggggatgcttacatggtggtatctggcctcccaggccgaaatggtcaacgccatgcaccagaaattgctcgtatggccctagcattactagatgcagtttcttcctttcgcatccgccaccgaccccatgaccagctgaggctacgcataggggtccatactgggccagtctgtgctggggttgttggcctgaagatgccccgttattgtctttttggagacacagtgaacactgcttctcgaatggagtctaatggtcaagcgctgaagatccatgtctcctctaccaccaaggatgccctagatgagctaggatgcttccagctagagcttcggggggatgtggaaatgaagggaaaaggaaagatgcgaacatactggctcttaggagagcggaaaggacctcctggactcctgtaaacccccattctttccaagtcagatagtcttctgctgctggtacctgggtgggcaatggccaccatgtctgcacacaccagaaatggacattttcatatgcaatggaaaacagccacaaaaaaacctaccttatatggaagttgtagccctctgcagctcagccctgtacatatacctgtccctctctggcttggtccccttcctccctactttctgtaaatatctgtatctaaaccagaatattttggtcaaatataaaacaataataaaaaaagttctgatgtcaaagtgtgggataggggcaatcccaag

SEQ ID NO: 124 - protein, 149 aa, Homo sapiens
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYREWLCCGALLSPGTEAVSTECTQSPSVPAPGHCHRGALPP

SEQ ID NO: 125 - DNA, 1443 bp, Homo sapiens
gtggggggagggagaagactgaataagccgtgaactgggcagctgtgacacgcgcaccttgtcaccttgtcaccaatttcctgcccgggatcccagagctacccttcttggagcccacaggggtaaggttgagcttctcactttccctccaatgaagcgtggcagcatgggaaggattttggcagtgtcgaggtctgagttttagtccgttcccctctctgggtctcagtttctcgctggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccgtgagtggctgtgctgcggggccctcctctcccctgggacagaggctgtgtctactgaatgcacacagagcccctctgtgcctgctcctgggcactgtcatcgtggggccctgcctccctgagctcctggggtgacaaggggcaggaccaggccagcccttggttggatgccttgagcccgctggcatctcaagacgcagacaacccacattttgagtcttgcttaggggaggacaatctaaccaacatttagccaaatccagaagtcatttcccaacatagctgagtcaccagagcaccccatgtcccatgccaagtagtggggtcaccatcaggggagctgagcctgtccatctcatggcaagaaggttgaagtgtcgcccagggtttttatcttcccctcagggcccacagcaaatgtgtggccatcacactccacctgcacatgagccatgaaaaccttccagatgggctgggataggacatcttggcgctaagggtatcacctgggtccattccatcaccagtttcagtggatcaatgaacagaaaaacatcttaaatccaacatattttctcggggtgggaggtggggtgagtggaagtgaagtattctaattcaaaagagaatccagggcaccccctcgggtggttgaatacgtgaggaatcgtggtggccatggccctgaccctggagaacctgggcaggtctggctctggcctctgcctcctaagtgatgaacttcacagctcagttcctccagtgcccagttccagtgagcaatgcccatctaagtctctctcaacgtgatcacccaactgtttaatgtttg

SEQ ID NO: 126 - protein, 164 aa, Homo sapiens
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYLGCTISEPCPCRHLVTGNHHVCKTTTQSSLHPQLLPSSSLHWSRPGHLLPNRGTP

SEQ ID NO: 127 - DNA, 1328 bp, Homo sapiens
gtggggggagggagaagactgaataagccgtgaactgggcagctgtgacacgcgcaccttgtcaccttgtcaccaatttcctgcccgggatcccagagctacccttcttggagcccacaggggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccttggctgtacaatttctgaaccttgtccttgtagacacctggtcaccggaaaccatcatgtctgtaaaactaccacacagtccagcctccatcctcaactgctgccctcttcctctctgcactggagccggccaggccacctcctccccaaccgtggaacaccatgagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggacttagccctgtgcccacagt

SEQ ID NO: 128 - protein, 207 aa, Homo sapiens
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 129 - protein, 435 aa, Homo sapiens
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 130 - protein, 825 aa, Homo sapiens
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 131 - protein, 1048 aa, Homo sapiens
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHIFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 132 - protein, 557 aa, Homo sapiens [sequence omitted]

SEQ ID NO: 133 - protein, 700 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIP

SEQ ID NO: 134 - protein, 116 aa, Homo sapiens
MESSRVRLLPLLGAALLLMLPLLGTRAQEDAELQPRALDIYSAVDDASHEKELIEALQEVLKKLKSKRVPIYEKKYGQVPMCDAGEQCAVRKGARIGKLCDCPRGTSCNSFLLKCL

SEQ ID NO: 135 - protein, 766 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 136 - protein, 261 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 137 - protein, 240 aa, Macaca nemestrina
MIETYNQPSPRSAATGLPVRMKIFMYLLTIFLITQMIGSALFAVYLHRRLDKIEDERNLHEDFVFMKTIQRCNTGERSLSLLDCEEIKSQFEGFVKDIMLNKEEKKKENSFEMQKVLQWAEKGYYTMSNNLVTLENGKQLTVKRQGLYYIYAQVTFCSNREASSQAPFIASLCLKSPGRFERILLRAANTHSSTKPCGQQSIHLGGVFELQPGASVFVNVTDPSQVSHGTGFTSFGLLKL

SEQ ID NO: 138 - DNA, 3882 bp, Homo sapiens
  misc_feature (108)..(203): CDS
gctttcagtcgagggctagcgagcgcagcggagcctggagagaaggcgctgggctgcgagggcgcgagggcgcgagggcagggggcaaccggaccccgcccttacccatggcgcccgtcgccgtctgggccgcgctggccgtcggactggagctctgggctgcggcgcacgccttgcccgcccagggttttgcagctcactagaggcagagccaagactccaccccaggtggccaggctcctgagcgctatgcctacctcaccctccaatgaggtggtggtggaggagaccgtgagccgctgtcacctgaacactggtgcactcagtctgctgctctgaggacgccgccccctctctttgtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgggttgtggaaagcctctgctgccatggtgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttacacgtcgacccctgg

SEQ ID NO: 139 - protein, 610 aa, Homo sapiens
MIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQIVNCTALESPEHGSLVCSHPLGNFSYNSSCSISCDRGYLPSSMETMQCMSSGEWSAPIPACNVVECDAVTNPANGFVECFQNPGSFPWNTTCTFDCEEGFELMGAQSLQCTSSGNWDNEKPTCKAVTCRAVRQPQNGSVRCSHSPAGEFTFKSSCNFTCEEGFMLQGPAQVECTTQGQWTQQIPVCEAFQCTALSNPERGYMNCLPSASGSFRYGSSCEFSCEQGFVLKGSKRLQCGPTGEWDNEKPTCEAVRCDAVHQPPKGLVRCAHSPIGEFTYKSSCAFSCEEGFELHGSTQLECTSQGQWTEEVPSCQVVKCSSLAVPGKINMSCSGEPVFGTVCKFACPEGWTLNGSAARTCGATGHWSGLLPTCEAPTESNIPLVAGLSAAGLSLLTLAPFLLWLRKCLRKAKKFVPASSCQSLESDGSYQKPSYIL

SEQ ID NO: 140 - protein, 372 aa, Homo sapiens [sequence omitted]

SEQ ID NO: 141 - protein, 1152 aa, Homo sapiens
MALRVLLLTALTLCHGFNLDTENAMTFQENARGFGQSVVQLQGSRVVVGAPQEIVAANQRGSLYQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGRARWQCDAVLYGEQGQPWGRFGAALTVLGDVNGDKLTDVAIGAPGEEDNRGAVYLFHGTSGSGISPSHSQRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGALKSTSCSINHPIFPENSEVTFNITFDVDSKASLGNKLLLKANVTSENNMPRTNKTEFQLELPVKYAVYMVVTSHGVSTKYLNFTASENTSRVMQHQYQVSNLGQRSLPISLVFLVPVRLNQTVIWDRPQVTFSENLSSTCHTKERLPSHSDFLAELRKAPVVNCSIAVCQRIQCDIPFFGIQEEFNATLKGNLSFDWYIKTSHNHLLIVSTAEILFNDSVFTLLPGQGAFVRSQTETKVEPFEVPNPLPLIVGSSVGGLLLLALITAALYKLGFFKRQYKDMMSEGGPPGAEPQ

SEQ ID NO: 142 - protein, 1170 aa, Homo sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILACDPGLSRTCDQNTYLSGLCYLFRQNLQGPMLQGRPGFQECIKGNVDLVFLFDGSMSLQPDEFQKILDFMKDVMKKLSNTSYQFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLYPQFQGRLVANLTYTLQLDGHRTRRRGLFPGGRHELRRNIAVTTSMSCTDFSFHFPVCVQDLISPINVSLNFSLWEEEGTPRDQRAQGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 143 - protein, 1039 aa, Homo sapiens
MARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRDETRNVGSQTLQTFKARQGLGASVVSWSDVIVACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRAEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQRPLDQFVLQSHAWFNVSSLPYAVPPLSLPRGEAQVWTQLLRALEERAIPIWWVLVGVLGGLLLLTILVLAMWKVGFFKRNRPPLEEDDEEGE

SEQ ID NO: 144 - protein, 798 aa, Homo sapiens
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTVTFWVSLQATHCLPEPHLLRLRALGFSEELIVELHTLCDCNCSDTQPQAPHCSDGQGHLQCGVCSCAPGRLGRLCECSVAELSSPDLESGCRAPNGTGPLCSGKGHCQCGRCSCSGQSSGHLCECDDASCERHEGILCGGFGRCQCGVCHCHANRTGRACECSGDMDSCISPEGGLCSGHGRCKCNRCQCLDGYYGALCDQCPGCKTPCERHRDCAECGAFRTGPLATNCSTACAHTNVTLALAPILDDGWCKERTLDNQLFFFLVEDDARGTVVLRVRPQEKGADHTQAIVLGCVGGIVAVGLGLVLAYRLSVEIYDRREYSRFEKEQQQLNWKQDSNPLYKSAITTTINPRFQEADSPTL

SEQ ID NO: 145 - protein, 427 aa, Homo sapiens
MEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVQEAKCENPEFERNVENTSCFMVPGVLPDTLNTVRIRVKTNKLCYEDDKLWSNWSQEMSIGKKRNSTLYITMLLIVPVIVAGAIIVLLLYLKRLKIIIFPPIPDPGKIFKEMFGDQNDDTLHWKKYDIYEKQTKEETDSVVLIENLKKASQ

SEQ ID NO: 146 - protein, 688 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 147 - protein, 1676 aa, Homo sapiens
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVILNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGIGISNTGICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 148 - protein, 2039 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFSLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYTCDPGYLLVGKGFIFCTDQGIWSQLDHYCKEVNCSFPLFMNGISKELEMKKVYHYGDYVTLKCEDGYTLEGSPWSQCQADDRWDPPLAKCTSRAHDALIVGTLSGTIFFILLIIFLSWIILKHRKGNNAHENPKEVAIHLHSQGGSSVHPRTLQTNEENSRVLP

SEQ ID NO: 149 - protein, 1038 aa, Homo sapiens
MFPTESAWLGKRGANPGPEAAVRETVMLLLCLGVPTGRPYNVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVTCGHRWKNIFYIKNENKLPTGGCYGVPPDLRTELSKRIAPCYQDYVKKFGENFASCQAGISSFYTKDLIVMGAPGSSYWTGSLFVYNITTNKYKAFLDKQNQVKFGSYLGYSVGAGHFRSQHTTEVVGGAPQHEQIGKAYIFSIDEKELNILHEMKGKKLGSYFGASVCAVDLNADGFSDLLVGAPMQSTIREEGRVFVYINSGSGAVMNAMETNLVGSDKYAARFGESIVNLGDIDNDGFEDVAIGAPQEDDLQGAIYIYNGRADGISSTFSQRIEGLQISKSLSMFGQSISGQIDADNNGYVDVAVGAFRSDSAVLLRTRPVVIVDASLSHPESVNRTKFDCVENGWPSVCIDLTLCFSYKGKEVPGYIVLFYNMSLDVNRKAESPPRFYFSSNGTSDVITGSIQVSSREANCRTHQAFMRKDVRDILTPIQIEAAYHLGPHVISKRSTEEFPPLQPILQQKKEKDIMKKTINFARFCAHENCSADLQVSAKIGFLKPHENKTYLAVGSMKTLMLNVSLFNAGDDAYETTLHVKLPVGLYFIKILELEEKQINCEVTDNSGVVQLDCSIGYIYVDHLSRIDISFLLDVSSLSRAEEDLSITVHATCENEEEMDNLKHSRVTVAIPLKYEVKLTVHGFVNPTSFVYGSNDENEPETCMVEKMNLTFHVINTGNSMAPNVSVEIMVPNSFSPQTDKLFNILDVQTTTGECHFENYQRVCALEQQKSAMQTLKGIVRFLSKTDKRLLYCIKADPHCLNFLCNFGKMESGKEASVHIQLEGRPSILEMDETSALKFEIRATGFPEPNPRVIELNKDENVAHVLLEGLHHQRPKRYFTIVIISSSLLLGLIVLLLISYVMWKAGFFKRQYKSILQEENRRDSWSYINSKSNDD

SEQ ID NO: 150 - protein, 562 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 151 - protein, 353 aa, Homo sapiens
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSLVLTLNELPNRTSGLLETNFTASARTTGSGLLKWQQGFRAKIPGLLNQTSRSLDQIPGYLNRIHELLNGTRGLFPGPSRRTLGAPDISSGTSDTGSLPPNLQPGYSPSPTHPPTGQYTLFPLPPTLPTPVVQLHPLLPDPSAPTPTPTSPLLNTSYTHSQNLSQEG

SEQ ID NO: 152 - protein, 1038 aa, Homo sapiens
MTSSLQRPWRVPWLPWTILLVSTAAASQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLSPPHSFNRDETIIIALASVSVLAVLIVALCFGYRMLTGDRKQGLHSMNMMEAAASEPSLDLDNLKLLELIGRGRYGAVYKGSLDERPVAVKVFSFANRQNFINEKNIYRVPLMEHDNIARFIVGDERVTADGRMEYLLVMEYYPNGSLCKYLSLHTSDWVSSCRLAHSVTRGLAYLHTELPRGDHYKPAISHRDLNSRNVLVKNDGTCVISDFGLSMRLTGNRLVRPGEEDNAAISEVGTIRYMAPEVLEGAVNLRDCESALKQVDMYALGLIYWEIFMRCTDLFPGESVPEYQMAFQTEVGNHPTFEDMQVLVSREKQRPKFPEAWKENSLAVRSLKETIEDCWDQDAEARLTAQCAEERMAELMMIWERNKSVSPTVNPMSTAMQNERNLSHNRRVPKIGPYPDYSSSSYIEDSIHHTDSIVKNISSEHSMSSTPLTIGEKNRNSINYERQQAQARIPSPETSVTSLSTNTTTTNTTGLTPSTGMTTISEMPYPDETNLHTTNVAQSIGPTPVCLQLTEEDLETNKLDPKEVDKNLKESSDENLMEHSLKQFSGPDPLSSTSSSLLYPLIKLAVEATGQQDFTQTANGQACLIPDVLPTQIYPLPKQQNLPKRPTSLPLNTKNSTKEPRLKFGSKHKSNLKQVETGVAKMNTINAAEPHVVTVTMNGVAGRNHSVNSHAATTQYANGTVLSGQTTNIVTHRAQEMLQNQFIGEDTRLNINSSPDEHEPLLRREQQAGHDEGVLDRLVDRRERPLEGGRTNSNNNNSNPCSEQDVLAQGVPSTAADPGPSKPRRAQRPNSLDLSATNVLDGSSIQIGESTQDGKSGSGEKIKKRVKTPYSLKRWRPSTWVISTESLDCEVNNNGSNRAVHSKSSTAVYLAEGGTATTMVSKDIGMNCL

SEQ ID NO: 153 - protein, 1047 aa, Homo sapiens
MALPSLLLLVAALAGGVRPPGARNLTLAVVLPEHNLSYAWAWPRVGPAVALAVEALGRALPVDLRFVSSELEGACSEYLAPLSAVDLKLYHDPDLLLGPGCVYPAASVARFASHWRLPLLTAGAVASGFSAKNDHYRTLVRTGPSAPKLGEFVVTLHGHFNWTARAALLYLDARTDDRPHYFTIEGVFEALQGSNLSVQHQVYAREPGGPEQATHFIRANGRIVYICGPLEMLHEILLQAQRENLTNGDYVFFYLDVFGESLRAGPTRATGRPWQDNRTREQAQALREAFQTVLVITYREPPNPEYQEFQNRLLIRAREDFGVELGPSLMNLIAGCFYDGILLYAEVLNETIQEGGTREDGLRIVEKMQGRRYHGVTGLVVMDKNNDRETDFVLWAMGDLDSGDFQPAAHYSGAEKQIWWTGRPIPWVKGAPPSDNPPCAFDLDDPSCDKTPLSTLAIVALGTGITFIMFGVSSFLIFRKLMLEKELASMLWRIRWEELQFGNSERYHKGAGSRLTLSLRGSSYGSLMTAHGKYQIFANTGHFKGNVVAIKHVNKKRIELTRQVLFELKHMRDVQFNHLTRFIGACIDPPNICIVTEYCPRGSLQDILENDSINLDWMFRYSLINDLVKGMAFLHNSIISSHGSLKSSNCVVDSRFVLKITDYGLASFRSTAEPDDSHALYAKKLWTAPELLSGNPLPTTGMQKADVYSFGIILQEIALRSGPFYLEGLDLSPKEIVQKVRNGQRPYFRPSIDRTQLNEELVLLMERCWAQDPAERPDFGQIKGFIRRFNKEGGTSILDNLLLRMEQYANNLEKLVEERTQAYLEEKRKAEALLYQILPHSVAEQLKRGETVQAEAFDSVTIYFSDIVGFTALSAESTPMQVVTLLNDLYTCFDAIIDNFDVYKVETIGDAYMVVSGLPGRNGQRHAPEIARMALALLDAVSSFRIRHRPHDQLRLRIGVHTGPVCAGVVGLKMPRYCLFGDTVNTASRMESNGQALKIHVSSTTKDALDELGCFQLELRGDVEMKGKGKMRTYWLLGERKGPPGLL

SEQ ID NO: 154 - protein, 275 aa, Homo sapiens
MSSFGYRTLTVALFTLICCPGSDEKVFEVHVRPKKLAVEPKGSLEVNCSTTCNQPEVGGLETSLNKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIYEPVSDSQMVIIVTVVSVLLSLFVTSVLLCFIFGQHLRQQRMGTYGVRAAWRRLPQAFRP

SEQ ID NO: 155 - protein, 197 aa, Homo sapiens
MLLSQNAFIFRSLNLVLMVYISLVFGISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKGEDEKLDISQFCHRQAL

SEQ ID NO: 156 - DNA, 1508 bp, Homo sapiens
sgccmssgcccccgcgccggcggcggcgcggcgcccgcgcttccgtagcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagggagaagatgagaaactagacatcagtcagttttgtcacagacaagctctgtgaccttggagaagttacttagccacactgagctacagttttctcatccgttgaatggagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctga

SEQ ID NO: 157 - protein, 515 aa, Homo sapiens [sequence omitted]

SEQ ID NO: 158 - protein, 17 aa, Homo sapiens
  misc_feature: HSIFNABR_P8 unique region
GEDEKLDISQFCHRQAL

SEQ ID NO: 159 - DNA, 2205 bp, Homo sapiens
gggagcgaggccgtcacgagggactcactggtgcctgccttggggctccgggactgtgggctgtctccatccggaggtctccctaccaccaggctctgtggggcagggaagcccagtggggtgcagggagccaggaagctggggtggggtcagggcagggtccacagggagaccgggcgaggctggcagccttcccagtccgcgcagcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccccggggagcagccgagggtccctgagtgtgtgagtgaggtggggaaacacagatggactttggggggctcccccttctacaggaaacccggagtggactggaacggtgcagggggagaactcgcccctcccatcgggcgcctccttcataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaattggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcgaaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaactgtcacctcc

SEQ ID NO: 160 - protein, 197 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTNWPNHMCEKKKAKG

SEQ ID NO: 161 - protein, 283 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGDVVKVIVSVQRKRQEAEGEATVIEALQAPPDVTTVAVEETIPSFTGRSPNH

SEQ ID NO: 162 - protein, 14 aa, Homo sapiens
  misc_feature: Z42185_P5 unique region
NWPNHMCEKKKAKG

SEQ ID NO: 163 - DNA, 759 bp, Homo sapiens
atccagggtgaggaaggcagcccacacttttcttggagacacatccccaaagamgtcctcacgtggctccgtttgggcagaaaccatgaattgaacgggaaaagaaatatgtcaagtatcagaaagaagagtggcatgctttgacagcaagtggactccgagtccagggcagagcctcaggggccgctctctgacatcagagctgctgtagagcggagaggggcaggggtgaagggccacggtggtgcaacccaccacttcctccaaggaggagctgagaggaacaggaagtgtcaggacttcacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgggagcggctttgggtcctccagcccacgccaccgcggcgagcagtccccggaggagaagccgggtggctcccgtctgtcctcggactgagcagggtggccaggccccaggtggaaactaccttggtcaggctgggttttttccctcccctttctggaggttttcagctcctctgaaataaacacctttcagtgagaaaa

SEQ ID NO: 164 - protein, 108 aa, Homo sapiens
MLGLRPPLLALVGLLSLGCVLSQECTKFKVSSCRECIESGPGCTWCQKLGAALGPPAHATAASSPRRRSRVAPVCPRTEQGGQAPGGNYLGQAGFFPSPFWRFSAPLK

SEQ ID NO: 165 - protein, 769 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 166 - protein, 59 aa, Homo sapiens
  misc_feature: HUMLAP_P15 unique region
GAALGPPAHATAASSPRRRSRVAPVCPRTEQGGQAPGGNYLGQAGFFPSPFWRFSAPLK

SEQ ID NO: 167 - DNA, 1369 bp, Homo sapiens
atccagggtgaggaaggcagcccacacttttcttggagacacatccccaaagamgtcctcacgtggctccgtttgggcagaaaccatgaattgaacgggaaaagaaatatgtcaagtatcagaaagaagagtggcatgctttgacagcaagtggactccgagtccagggcagagcctcaggggccgctctctgacatcagagctgctgtagagcggagaggggcaggggtgaagggccacggtggtgcaacccaccacttcctccaaggaggagctgagaggaacaggaagtgtcaggacttcacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccaattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaaaaaaaaaa

SEQ ID NO: 168 - protein, 272 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFSALKMTAMAGRVLLGARRGDSSTLTGTVFAWRLEEGGLEVGEVRCVFPVQVRTSV

SEQ ID NO: 169 - protein, 55 aa, Homo sapiens
  misc_feature: HUMLAP_P12 unique region
SALKMTAMAGRVLLGARRGDSSTLTGTVFAWRLEEGGLEVGEVRCVFPVQVRTSV

SEQ ID NO: 170 - DNA, 661 bp, Homo sapiens
cagatccagtggcccggaggggcctgagctaaatccgcaggacctgggtaacacgaggaagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggtgagttgatgaaggggaagaggaaaatcaccaataaagggtgaaacaaagggtcctgaaatacttggtaagagccagagatgatattcttagagataaaagctaagatgagatgatgtgtggtcccactgaatggtatcagagttgtagtcctagctctaagtaggtcttgggcaaaatgtcaaagcctgtcagaccagtagatataggactgctgcatgcacaattccagaacgg

SEQ ID NO: 171 - protein, 120 aa, Homo sapiens
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGELMKGKRKITNKG

SEQ ID NO: 172 - protein, 13 aa, Homo sapiens
  misc_feature: HUMGCRFC_P3 unique region
ELMKGKRKITNKG

SEQ ID NO: 173 - protein, 254 aa, Homo sapiens
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 174 - DNA, 802 bp, Homo sapiens
cagatccagtggcccggaggggcctgagctaaatccgcaggacctgggtaacacgaggaagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggccctttcccgaccatgacctcatgttctctctttgtgaagtctgattacttggtgacatgatcgtgagaataagctctggcgatataagaatttcctctcttgaaggccatgctcagtaaattacttggtgacatgatcgtgagaataagctctggcgatacaagaatttcctctcttgaaggccatgctcagtaataaagttggtctcaccgaggccctgtgacaccttagaaaccacgaattgccaggctgagcaataccagtcccgcccttcccctccctggtgtttacattgagttctccttcacaatttctgcagccactccgtggccaccgtcaccttattcctgactgccacaagagtctttcaatattc

SEQ ID NO: 175 - protein, 126 aa, Homo sapiens
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGPFPTMTSCSLFVKSDYLVT

SEQ ID NO: 176 - protein, 19 aa, Homo sapiens
  misc_feature: HUMGCRFC_P4 unique region
PFPTMTSCSLFVKSDYLVT

SEQ ID NO: 177 - DNA, 2310 bp, Homo sapiens
gattgcgacaggccggcctggctcccagcgctccctgtccccgccccgcggccagctcgctccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcagaacctgccctgagcaagggggtggagaacttgcaagccctgctctaccaggcggccacaggcagttccgaagcaagtttccctactctctcacccctgtaaacacccccacaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 178 - protein, 255 aa, Homo sapiens
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSEPALSKGVENLQALLYQAATGSSEASFPTLSPL

SEQ ID NO: 179 - protein, 33 aa, Homo sapiens
  misc_feature: HUMTNFRRP_P2 unique region
EPALSKGVENLQALLYQAATGSSEASFPTLSPL

SEQ ID NO: 180 - DNA, 1140 bp, Homo sapiens
gattgcgacaggccggcctggctcccagcgctccctgtccccgccccgcggccagctcgctccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcagaacctgccctgagcaagggggtggagaacttgcaagccctgctctaccaggcggccacaggcagttccgaagcaagtttccctactctctcacccctgtaaacacccccacaggagctgcattgtgtctagaaggaaaaaagctgctcccttttctctgtctgggttgcccagggatctggaaagctcttccttctcctcctcccctctgccc

SEQ ID NO: 181 - DNA, 2631 bp, Homo sapiens
aggaaaagaggcttagggccgggtgagccttccagccagggcctgcctccaagtgatgctcccccagggcagggggcataaggatggcacccagccaggtgggagcctgggccctgcccagcctcaaagctttgagctcaggaaatccggaggcaggggagggggacatcgttgccacattccccagccctttaagacccccaaggcaggaaggctgcccgggcctcaccagcttccctcacaggctccttcctgggaggaaggggctgcctgtgccctcgaaggcgcaagggagggcaggagggaggctcggaaggtgttgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatgggtttgtcaactatcaggcccctttccagaatcctctcctctctctcccaaggctctgcctggtccccagcaatcagaagtatagggaacattgccttcctaccatacttccagccctggagaggatctctcccaatcccctggcttacactggatccctacagctggacagaaatcaggtgctgggatagaaattgagtagggagttggcacaattcaaggagcaaacctggcaaaaatcaaaccatttcccagacaaaaataaggtgttatatgtaacagaaattggacagaggggccgggtgcagtggctcacacctgtaatcctaacactctgggaggccagggcaggcagatcccctgagttcaagagtttgagaccagcctaggcaaccttgtctctacagaaaaataaataaataaataaataaacaaacaaacaaaccaaaaattagctgggtgcagtgacacatgcctgtaaccccagctacttgagaggctgaggt

SEQ ID NO: 182 - protein, 590 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMGLSTIRPLSRILSSLSQGSAWSPAIRSIGNIAFLPYFQPWRGSLPIPWLTLDPYSWTEIRCWDRN

SEQ ID NO: 183 - DNA, 1742 bp, Homo sapiens
cttctctgccagaagataccatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacatta

SEQ ID NO: 184 - protein, 65 aa, Homo sapiens
  misc_feature: HSGCSFR2_P11 unique region
GLSTIRPLSRILSSLSQGSAWSPAIRSIGNIAFLPYFQPWRGSLPIPWLTLDPYSWTEIRCWDRN

SEQ ID NO: 185 - DNA, 3510 bp, Homo sapiens
aggaaaagaggcttagggccgggtgagccttccagccagggcctgcctccaagtgatgctcccccagggcagggggcataaggatggcacccagccaggtgggagcctgggccctgcccagcctcaaagctttgagctcaggaaatccggaggcaggggagggggacatcgttgccacattccccagccctttaagacccccaaggcaggaaggctgcccgggcctcaccagcttccctcacaggctccttcctgggaggaaggggctgcctgtgccctcgaaggcgcaagggagggcaggagggaggctcggaaggtgttgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctgcctatgctgaccgtacacccctcccagccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtaaagagtctctgttatttatttttcagggcccagcagtcagggggaaacttctcagagttggtcctttcttcctccctcccttccttcctccctcccttccttccccc

SEQ ID NO: 186 - protein, 577 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFCLC

SEQ ID NO: 187 - protein, 66 aa, Homo sapiens
  misc_feature: HSGCSFR2_P7 unique region
SAILNASSRGFVLHGLEPASLYHIHLMAASQAGATNSTVLTLMTLTPEGSELHIILGLFGLLLLLT

SEQ ID NO: 188 - DNA, 3594 bp, Homo sapiens
aggaaaagaggcttagggccgggtgagccttccagccagggcctgcctccaagtgatgctcccccagggcagggggcataaggatggcacccagccaggtgggagcctgggccctgcccagcctcaaagctttgagctcaggaaatccggaggcaggggagggggacatcgttgccacattccccagccctttaagacccccaaggcaggaaggctgcccgggcctcaccagcttccctcacaggctccttcctgggaggaaggggctgcctgtgccctcgaaggcgcaagggagggcaggagggaggctcggaaggtgttgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctgtgagtctatcctcagttcccccacagccccagaaggcctggaagggggtgctcagctgccacggaggcagctttaccatccaggcctatgctgaccgtacacccctcccagccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtaaagagtctctgttatttatttttcagggcccagcagtcagggggaaacttctcagagttggtcctttcttcctccctcccttccttcctccctcccttccttccccc

SEQ ID NO: 189 - protein, 605 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFCESILSSPTAPEGLEGGAQLPRRQLYHPGLC

SEQ ID NO: 190 - protein, 31 aa, Homo sapiens
  misc_feature: HSGCSFR2_P8 unique region
CESILSSPTAPEGLEGGAQLPRRQLYHPGLC

SEQ ID NO: 191 - DNA, 1287 bp, Homo sapiens
tcgccttccttcgggactccggatcgatctggagctccgggaatttccctggcccggccgctccgggctttccagtctcaaccatgcataaaaagggttcgccgatcttggggagccacacagcccgggtcgcaggcacctccccgccagctctcccgcttctcgcacagcttcccgacgcgtctgctgagccccatggcccacgccacgctctccgccgcccccagcaatccccggctcctgcgggtggcgctgctgctcctgctcctggtggccgccagccggcgcgcagcaggtgggtcccggcgccctggggtccccgggccggacgcggctggggtgggcgccccgcgccgacagccccgctcaatcagcgagtctattcttccctaggagcgtccgtggtcactgaactgcgctgccagtgcttgcagacactgcagggaattcacctcaagaacatccaaagtgtgaatgtaaggtcccccggaccccactgcgcccaaaccgaagtcatagccacactcaagaatgggaagaaagcttgtctcaaccccgcatcccccatggttcagaaaatcatcgaaaagatactgaacaaggggagcaccaactgacaggagagaagtaagaagcttatcagcgtatcattgacacttcctgcagggtggtccctgcccttaccagagctgaaaatgaaaaagagaacagcagctttctagggacagctggaaaggacttaatgtgtttgactatttcttacgagggttctacttatttatgtatttatttttgaaagcttgtattttaatattttacatgctgttatttaaagatgtgagtgtgtttcatcaaacatagctcagtcctgattatttaattggaatatgatgggttttaaatgtgtcattaaactaatatttagtgggagaccataatgtgtcagccaccttgataaatgacagggtggggaactggagggtggggggattgaaatgcaagcaattagtggatcactgttagggtaagggaatgtatgtacacatctattttttatactttttttttaaaaaaagaatgtcagttgttatttattcaaattatctcacattatgtgttcaacatttttatgctgaagtttcccttagacattttatgtcttgcttgtagggcataatgccttgtttaatgtccattctgcagcgtttctctttcccttggaaaagagaatttatcattactgttacatttgtacaaatgacatgataataaaagttttatgaaaaa

SEQ ID NO: 192 - protein, 177 aa, Homo sapiens
MHKKGSPILGSHTARVAGTSPPALPLLAQLPDASAEPHGPRHALRRPQQSPAPAGGAAAPAPGGRQPARSRWVPAPWGPRAGRGWGGRPAPTAPLNQRVYSSLGASVVTELRCQCLQTLQGIHLKNIQSVNVRSPGPHCAQTEVIATLKNGKKACLNPASPMVQKIIEKILNKGSTN

SEQ ID NO: 193 - protein, 107 aa, Homo sapiens
MAHATLSAAPSNPRLLRVALLLLLLVAASRRAAGASVVTELRCQCLQTLQGIHLKNIQSVNVRSPGPHCAQTEVIATLKNGKKACLNPASPMVQKIIEKILNKGSTN

SEQ ID NO: 194 - DNA, 3510 bp, Homo sapiens
atcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagggacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 195 - protein, 181 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECSPCGPCSERRKHLFVQDPQTCKCSCKNTDSRCKARQLELNERTCRCDKPRR

SEQ ID NO: 196 - protein, 232 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 197 - DNA, 3378 bp, Homo sapiens
atcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 198 - protein, 52 aa, Homo sapiens
  misc_feature: HUMEGFAA_P6 unique region
RPKKDRARQEKKSVRGKGKGQKRKRKKSRYKSWSVYVGARCCLMPWSLPGPH

SEQ ID NO: 199 - protein, 137 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQTCKCSCKNTDSRCKARQLELNERTCRCDKPRR

SEQ ID NO: 200 - protein, 95 aa, Homo sapiens
  misc_feature: HUMEGFAA_P8 unique region
QIMRIKPHQGQHIGEMSFLQHNKCECRPKKDRARQEKKSVRGKGKGQKRKRKKSRYKSWSVYVGARCCLMPWSLPGPHPCGPCSERRKHLFVQDP

SEQ ID NO: 201 - DNA, 903 bp, Homo sapiens
atctccaaaaccccactttctccttcctttgagcctccgtaccagctggggcgtccggcaagatgtgagttgtcactctgctgcggcacagacctgaattaacaactctagctagggctgacttcaaaaagcactttcgttttttaataaccaacatcagctcagcaggcttcatttgggaaaagaaaccttgtcggattaccccgacattctccacctcctgggaggccagccattcccaaatgccccaaggatgaagaacggagacggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggtaattttattttaaatatgacatttcacttttccagaaaataaaatagttccctggacaataga

SEQ ID NO: 202 - protein, 166 aa, Homo sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKVILF

SEQ ID NO: 203 - protein, 569 aa, Homo sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLTVIIVCSVFIYKIFKIDIVLWYRDSCYDFLPIKASDGKTYDAYILYPKTVGEGSTSDCDIFVFKVLPEVLEKQCGYKLFIYGRDDYVGEDIVEVINENVKKSRRLIIILVRETSGFSWLGGSSEEQIAMYNALVQDGIKVVLLELEKIQDYEKMPESIKFIKQKHGAIRWSGDFTQGPQSAKTRFWKNVRYHMPVQRRSPSSKHQLLSPATKEKLQREAHVPLG

SEQ ID NO: 204 - protein, 4 aa, Homo sapiens
  misc_feature: HUMIL1RA_P3 unique region
VILF

SEQ ID NO: 205 - DNA, 802 bp, Homo sapiens
aatgtgaaagatgattacagtggccagaggactgccaaggctccttctcaagctgcttgagtcaatgaggatgtagaaactgagatccagtgagatgaagtgattttcccaaagatacatagatgaagttgaagcttagctctttaacccaggtctgctggcgtccaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggtaattttattttaaatatgacatttcacttttccagaaaataaaatagttccctggacaataga

SEQ ID NO: 206 - DNA, 6036 bp, Homo sapiens
  misc_feature (112)..(4824)
acactctgggcgcggagcacaatgattggtcactcctattttcgctgagcttttcctcttatttcagttttcttcgaattcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttcttttccctcactgagatcatcagatttagatgtcagcccgggtttgtcatggtagggtcccacactgtgcagtgccagaccaatggcagatgggggcccaagctgccacactgctccagggtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtgcacatgatgctctcatagttgcaataatgcacatgaaaaccctaaagaagtggctatccatttacattctcaaggaggcagcagcgttcatccccgaactctgcaaacaaatgaagaaaatagcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggattaccagtagatgggactacaggcacctgccaacacgcccggctaatttttttgtatttttagtagagacggggtttcaccatgttagccaggatggtctggatctcctgacctcgtgatccacctgcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatattttt

SEQ ID NO: 207 - DNA, 2561 bp, Homo sapiens
  misc_feature (112)..(1866): CDS
acactctgggcgcggagcacaatgattggtcactcctattttcgctgagcttttcctcttatttcagttttcttcgaattcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggtgagttggcagcaacatctcttggtttaagagttccagcacagcgatagtactttctagccacatctcagcaaggaaactaggctattgccacctgctcttaagaggcttgaacacaggtgttaactcctgattgaaatgaacaaagataggagaagattagggggaaaatctgtatccttgctggaaaccagggcagtgcacatataaagagtatgctgttcactggatgggaaagaaaaaaacttagaagtgtagtagtcaaagcacacaaacaaccctaacccagagtagacattgctggaagaaagggaagaccatgtagcagctgtgtgagagaatgaatcttaatgataacagcatgatcccttgctagggctgccatcaaaaagtacaggccttcctcgttttattgtacttcgcagatgttatgctttttacaaattgaacgcttgtgggaacgctgtgtaagcatgttcgtcggcatcatttatccaacagcgtgtgttgacttcgtgtctctgtgtagcattttgattattctcacagtatcccagatgttttcattattatcatgtctgtgatagtgatctgtcatcagtgatctttgatgttactattgtcattgtttggggtccctacgaactgcacccatataagacagaaaacttaatcaataaatgtgcgtgctttgactgc

SEQ ID NO: 208 - DNA, 676 bp, Homo sapiens
  misc_feature (112)..(660): CDS
acactctgggcgcggagcacaatgattggtcactcctattttcgctgagcttttcctcttatttcagttttcttcgaattcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagtgagttgaaatatcccttcctatttcttttaccgacacattctaatttttctctggaataataaaaatcttaactga

SEQ ID NO: 209 - DNA, 7513 bp, Homo sapiens
  misc_feature (112)..(6174): CDS
acactctgggcgcggagcacaatgattggtcactcctattttcgctgagcttttcctcttatttcagttttcttcgaattcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctatgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttattgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttcttttccctcactgagatcatcagatttagatgtcagcccgggtttgtcatggtagggtcccacactgtgcagtgccagaccaatggcagatgggggcccaagctgccacactgctccagggtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtgcacatgatgctctcatagttgcaataatgcacatgaaaaccctaaagaagtggctatccatttacattctcaaggaggcagcagcgttcatccccgaactctgcaaacaaatgaagaaaatagcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggattaccagtagatgggactacaggcacctgccaacacgcccggctaatttttttgtatttttagtagagacggggtttcaccatgttagccaggatggtctggatctcctgacctcgtgatccacctgcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatatttttaaaataagtgaccttgtgttctttaaccagtccacatctttagagaacaaaaatgtgttatgatattatgggccatgctaatgacctctagaaaacatcagaatatttctggatatttaataatagc

SEQ ID NO: 210 - DNA, 6036 bp, Homo sapiens
  misc_feature (112)..(4824): CDS
acactctgggcgcggagcacaatgattggtcactcctattttcgctgagcttttcctcttatttcagttttcttcgaattcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttcttttccctcactgagatcatcagatttagatgtcagcccgggtttgtcatggtagggtcccacactgtgcagtgccagaccaatggcagatgggggcccaagctgccacactgctccagggtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtgcacatgatgctctcatagttgcaataatgcacatgaaaaccctaaagaagtggctatccatttacattctcaaggaggcagcagcgttcatccccgaactctgcaaacaaatgaagaaaatagcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggattaccagtagatgggactacaggcacctgccaacacgcccggctaatttttttgtatttttagtagagacggggtttcaccatgttagccaggatggtctggatctcctgacctcgtgatccacctgcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatattttt

SEQ ID NO: 211 - DNA, 125 bp, Homo sapiens
gagaatgggggcctcttctccaagaagcccggagcctgtcgggccgccggcgcccggtctccccttctgctgcggaggatccctgctggcggttgtggtgctgcttgcgctgccggtggcctggg

SEQ ID NO: 212 - DNA, 180 bp, Homo sapiens
gtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagac

SEQ ID NO: 213 - DNA, 399 bp, Homo sapiens
gaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccaggg

SEQ ID NO: 214 - DNA, 177 bp, Homo sapiens
tatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaag

SEQ ID NO: 215 - DNA, 218 bp, Homo sapiens
aaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctg

SEQ ID NO: 216 - DNA, 180 bp, Homo sapiens
gtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaac

SEQ ID NO: 217 - DNA, 399 bp, Homo sapiens
gaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccaggg

SEQ ID NO: 218 - DNA, 177 bp, Homo sapiens
tatgtcagccacctccagatgtcctgcatgctgagcgtacccaaagggacaaggacaacttttcacccgggcaggaagtgttctacagctgtgagcccggctacgacctcagaggggctgcgtctatgcgctgcacaccccagggagactggagccctgcagcccccacatgtgaag

SEQ ID NO: 219 - DNA, 219 bp, Homo sapiens
aaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgg

SEQ ID NO: 220 - DNA, 180 bp, Homo sapiens; identical to SEQ ID NO: 216

SEQ ID NO: 221 - DNA, 177 bp, Homo sapiens
tatgtcagccacctccagatgtcctgcatgctgagcgtacccaaagggacaaggacaacttttcacccgggcaggaagtgttctacagctgtgagcccggctatgacctcagaggggctgcgtctatgcgctgcacaccccagggagactggagccctgcagcccccacatgtgaag

SEQ ID NO: 222 - DNA, 219 bp, Homo sapiens
aaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgg

SEQ ID NO: 223 - DNA, 180 bp, Homo sapiens; identical to SEQ ID NO: 216

SEQ ID NO: 224 - DNA, 699 bp, Homo sapiens
gtgagttggcagcaacatctcttggtttaagagttccagcacagcgatagtactttctagccacatctcagcaaggaaactaggctattgccacctgctcttaagaggcttgaacacaggtgttaactcctgattgaaatgaacaaagataggagaagattagggggaaaatctgtatccttgctggaaaccagggcagtgcacatataaagagtatgctgttcactggatgggaaagaaaaaaacttagaagtgtagtagtcaaagcacacaaacaaccctaacccagagtagacattgctggaagaaagggaagaccatgtagcagctgtgtgagagaatgaatcttaatgataacagcatgatcccttgctagggctgccatcaaaaagtacaggccttcctcgttttattgtacttcgcagatgttatgctttttacaaattgaacgcttgtgggaacgctgtgtaagcatgttcgtcggcatcatttatccaacagcgtgtgttgacttcgtgtctctgtgtagcattttgattattctcacagtatcccagatgttttcattattatcatgtctgtgatagtgatctgtcatcagtgatctttgatgttactattgtcattgtttggggtccctacgaactgcacccatataagacagaaaacttaatcaataaatgtgcgtgctttgactgc

SEQ ID NO: 225 - DNA, 399 bp, Homo sapiens
gaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccaggg

SEQ ID NO: 226 - DNA, 177 bp, Homo sapiens
tgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcag

SEQ ID NO: 227 - DNA, 228 bp, Homo sapiens
atatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctg

SEQ ID NO: 228 - DNA, 180 bp, Homo sapiens
gtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagac

SEQ ID NO: 229 - DNA, 399 bp, Homo sapiens
tcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttcttttccctcactgagatcatcagatttagatgtcagcccgggtttgtcatggtagggtcccacactgtgcagtgccagaccaatggcagatgggggcccaagctgccacactgctccaggg

SEQ ID NO: 230 - DNA, 177 bp, Homo sapiens
tgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacag

SEQ ID NO: 231 - DNA, 228 bp, Homo sapiens
aaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctg

SEQ ID NO: 232 - DNA, 177 bp, Homo sapiens
cctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaag

SEQ ID NO: 233 - DNA, 186 bp, Homo sapiens
aagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctc

SEQ ID NO: 234 - DNA, 1371 bp, Homo sapiens
ggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggattaccagtagatgggactacaggcacctgccaacacgcccggctaatttttttgtatttttagtagagacggggtttcaccatgttagccaggatggtctggatctcctgacctcgtgatccacctgcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatatttttaaaataagtgaccttgtgttctttaaccagtccacatctttagagaacaaaaatgtgttatgatattatgggccatgctaatgacctctagaaaacatcagaatatttctggatatttaataatagc

SEQ ID NO: 235 - DNA, 107 bp, Homo sapiens
acactctgggcgcggagcacaatgattggtcactcctattttcgctgagcttttcctcttatttcagttttcttcgaattcaaatctggtttgtagatgtgcttggg

SEQ ID NO: 236 - DNA, 100 bp, Homo sapiens
gtaaatcatgtcgtaatcctccagatcctgtgaatggcatggtgcatgtgatcaaaggcatccagttcggatcccaaattaaatattcttgtactaaagg

SEQ ID NO: 237 - DNA, 86 bp, Homo sapiens
ataccgactcattggttcctcgtctgccacatgcatcatctcaggtgatactgtcatttgggataatgaaacacctatttgtgaca

SEQ ID NO: 238 - DNA, 78 bp, Homo sapiens
gtgagttgaaatatcccttcctatttcttttaccgacacattctaatttttctctggaataataaaaatcttaactga

SEQ ID NO: 239 - DNA, 103 bp, Homo sapiens
tgaaatcctgtgatgacttcatgggccaacttcttaatggccgtgtgctatttccagtaaatctccagcttggagcaaaagtggattttgtttgtgatgaagg

SEQ ID NO: 240 - DNA, 86 bp, Homo sapiens
atttcaattaaaaggcagctctgctagttactgtgtcttggctggaatggaaagcctttggaatagcagtgttccagtgtgtgaac

SEQ ID NO: 241 - DNA, 100 bp, Homo sapiens
gtaaatcatgtaaaactcctccagatccagtgaatggcatggtgcatgtgatcacagacatccaggttggatccagaatcaactattcttgtactacagg

SEQ ID NO: 242 - DNA, 86 bp, Homo sapiens
gcaccgactcattggtcactcatctgctgaatgtatcctctcgggcaatgctgcccattggagcacgaagccgccaatttgtcaac

SEQ ID NO: 243 - DNA, 103 bp, Homo sapiens; identical to SEQ ID NO: 239

SEQ ID NO: 244 - DNA, 86 bp, Homo sapiens; identical to SEQ ID NO: 240

SEQ ID NO: 245 - DNA, 100 bp, Homo sapiens; identical to SEQ ID NO: 241

SEQ ID NO: 246 - DNA, 103 bp, Homo sapiens; identical to SEQ ID NO: 239

SEQ ID NO: 247 - DNA, 86 bp, Homo sapiens
atttcaattaaaaggcagctctgctagttattgtgtcttggctggaatggaaagcctttggaatagcagtgttccagtgtgtgaac

SEQ ID NO: 248 - DNA, 100 bp, Homo sapiens; identical to SEQ ID NO: 241

SEQ ID NO: 249 - DNA, 86 bp, Homo sapiens
gcaccgactcattggtcactcatctgctgaatgtatcctctcaggcaatactgcccattggagcacgaagccgccaatttgtcaac

SEQ ID NO: 250 - DNA, 103 bp, Homo sapiens
tgaaatcctgtgatgacttcttgggtcaactccctcatggccgtgtgctatttccacttaatctccagcttggggcaaaggtgtcctttgtctgtgatgaagg

SEQ ID NO: 251 - DNA, 86 bp, Homo sapiens
gtttcgcttaaagggcagttccgttagtcattgtgtcttggttggaatgagaagcctttggaataacagtgttcctgtgtgtgaac

SEQ ID NO: 252 - DNA, 100 bp, Homo sapiens
gaaaatcatgtggacctccaccagaacccttcaatggaatggtgcatataaacacagatacacagtttggatcaacagttaattattcttgtaatgaagg

SEQ ID NO: 253 - DNA, 86 bp, Homo sapiens
gtttcgactcattggttccccatctactacttgtctcgtctcaggcaataatgtcacatgggataagaaggcacctatttgtgaga

SEQ ID NO: 254 - DNA, 103 bp, Homo sapiens
tgaaatcctgtgatgacttcctgggccaactccctcatggccgtgtgctacttccacttaatctccagcttggggcaaaggtgtcctttgtttgcgatgaagg

SEQ ID NO: 255 - DNA, 86 bp, Homo sapiens
gttccgattaaaaggcaggtctgctagtcattgtgtcttggctggaatgaaagccctttggaatagcagtgttccagtgtgtgaac

SEQ ID NO: 256 - DNA, 24 bp, Homo sapiens
gtgcacatgatgctctcatagttg

SEQ ID NO: 257 - DNA, 105 bp, Homo sapiens
caataatgcacatgaaaaccctaaagaagtggctatccatttacattctcaaggaggcagcagcgttcatccccgaactctgcaaacaaatgaagaaaatagcag

SEQ ID NO: 258 - protein, 2039 aa, Homo sapiens; identical to SEQ ID NO: 148

SEQ ID NO: 259 - protein, 2039 aa, Homo sapiens; identical to SEQ ID NO: 148

SEQ ID NO: 260 - protein, 2039 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFSLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRAHDALIVGTLSGTIFFILLIIFLSWIILKHRKGNNAHENPKEVAIHLHSQGGSSVHPRTLQTNEENSRVLP

SEQ ID NO: 261 - protein, 1570 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFSLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRAHDALIVAIMHMKTLKKWLSIYILKEAAAFIPELCKQMKKIAGSFLDKVLYS

SEQ ID NO: 262 - protein, 584 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTG

SEQ ID NO: 263 - protein, 182 aa, Homo sapiens; identical to SEQ ID NO: 107

SEQ ID NO: 264 - protein, 2020 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFSLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRAHDALIVAIMHMKTLKKWLSIYILKEAAAFIPELCKQMKKIAGSFLDKVLYS

SEQ ID NO: 265 - protein, 269 aa, Homo sapiens
MAEVPKLASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 266 - protein, 38 aa, Homo sapiens
  misc_feature: HSPROI1B_X1 unique region
VSECYGMKPFSASCYHLFPDNHLLPAPIPRKSWEQVYL

SEQ ID NO: 267 - protein, 1106 aa, Homo sapiens
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 268 - protein, 19 aa, Homo sapiens
  misc_feature: HUMPDGFR_P6 unique region
CESPASVAPDDPNPYLNPA

SEQ ID NO: 269 - DNA, 1242 bp, Homo sapiens
agaaatttctcagcctcctacttctgcttttgaaagctataaaaacagcgagggagaaactggcagataccaaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggaggtaagtgaatgctatggaatgaagcccttctcagcctcctgctaccacttattcccagacaaccaccttctccccgcccccatccctaggaaaagctgggaacaggtctatttgacaattttgcattaatgtaaataaatttaacataatttttaactgcgtgcaaccttcaatcctgctgcagaaaattaaatcattttgccgatgttattatgtcctaccatagttacaaccccaacagattatatattgttagggctgctctcatttgatagacaccttgggaaatagatgacttaaagggtcccattatcatgtccactccactcccaaaattaccaccactatcacctccagctttctcagcaaaagcttcatttccaagttgatgtcattctaggaccataaggaaaaatacaataaaaagcccctggaaactaggtacttcaagaagctctagcttaattttcacccccccaaaaaaaaaaaa

SEQ ID NO: 270 - protein, 241 aa, Homo sapiens
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLEVSECYGMKPFSASCYHLFPDNHLLPAPIPRKSWEQVYLTILH

SEQ ID NO: 271 - DNA, 2541 bp, Homo sapiens
ysagctcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactgtgagtccccagcctcagtggcccctgacgatcccaatccctaccttaaccctgcctaattggtaatgtgcccatgtacccacagcaggccaaaggagttagcatgcccaggggcaaacaggagcattgtgaaaccctgttgtgtacatgcataggaacacattctggcaaacacaatatgggtacacacgtgtacaaacacaagtctataagccatggatatgaatatccttcagtgtggtgtacatatactatatgtatgtcgtaagccatgtacatgagcatgcctgttccttgaacataggtgcaaatcctctgtgtgtagatatgtaaatcgtctactgaagaatgcccaatctccagtcactcctgtaaagctagagtgtatgtgtataagcatacacctgtgcactatgcctgtccatgtatgtaaacccaccacgtgtttgtaagccatgtacatgagcatgcctaattcccagacatctg

SEQ ID NO: 272 - protein, 545 aa, Homo sapiens
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHCESPASVAPDDPNPYLNPA

SEQ ID NO: 273 - DNA, 945 bp, Homo sapiens
gagtgagaactgtggccttggaccatgggagacctgcatttccaccacctgttctgggagtggggcccagtcagccccctttgcttaccttctgccctatattagagccccaggttctgtgcccttttcctatcatcgcaaaactcatgatgctccggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagcctcatcgcccccgactgggttgtgactgccggccactgcatctcgagctcctggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctcccgctggtgacatccttcccaacgagacaccctgctacatcaccggctggggccgtctctataccaacgggccactcccagacaagctgcaggaggccctgctgcccgtggtggactatgaacactgctccaggtggaactggtggggttcctccgtgaagaagaccatggtgtgtgctggaggggacatccgctccggctgcaacgaagcccacggtgttcactcgagtctccgccttcatcgactggattgaggagaccatagcaagccactagaaccaaggcccagctggcagtgctgatcgatcccacatcctgaataaagaataaagatctctcagaaaattccaaaaaaaaaaattt

SEQ ID NO: 274 - protein, 229 aa, Homo sapiens
MMLRLLSSLLLVAVASGYGPPSSRPSSRVVNGEDAVPYSWPWQVSLQYEKSGSFYHTCGGSLIAPDWVVTAGHCISSSWTYQVVLGEYDRAVKEGPEQVIPINSGDLFVHPLWNRSCVACGNDIALIKLSRSAQLGDAVQLASLPPAGDILPNETPCYITGWGRLYTNGPLPDKLQEALLPVVDYEHCSRWNWWGSSVKKTMVCAGGDIRSGCNEAHGVHSSLRLHRLD

SEQ ID NO: 275 - DNA, 643 bp, Homo sapiens
aagacgacagcagctgaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaaattaagttgcatcattttgtctga

SEQ ID NO: 276 - protein, 148 aa, Homo sapiens
MATGSRTSLLLAFGLLCLPWLQEGSAFPTIPLSRLFDNAMLRAHRLHQLAFDTYQEFLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 277 - DNA, 1174 bp, Homo sapiens
acccggttccggaatttcccgggattgaagaaaaactggcccaggggataaaaagggcccacaagagascggttctaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcgccaggggtcaccaatcctggaaccccactggcttcgagggctgggggagagaaatactgctgccctctttttagcagtaaggcgctgacccaagagaactcaccttattcttcatttcgcctggtgaatcctccaggcctttctctacaccctgaaggggagggaggaaaatggataaatgagagagggagggaacagtgcccaagcgcttggcctctccttctcttccttcactttgcagaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcatctgaaagaaaacattctat

SEQ ID NO: 278 - protein, 256 aa, Homo sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGVRVAPGVTNPGTPLASRAGGEKYCCPLFSSKALTQENSPYSSFRLVNPPGLSLHPEGEGGKWINERGREQCPSAWPLLLFLHFAEAGRRQPPDWADPQADLQQV

SEQ ID NO: 279 - DNA, 1009 bp, Homo sapiens
acccggttccggaatttcccgggattgaagaaaaactggcccaggggataaaaagggcccacaagagascggttctaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcgccaggggtcaccaatcctggaaccccactggcttcgagggctgggggagagaaatactgctgccctctttttagcaaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcatctgaaagaaaacattctat

SEQ ID NO: 280 - protein, 201 aa, Homo sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGVRVAPGVTNPGTPLASRAGGEKYCCPLFSKAGRRQPPDWADPQADLQQV

SEQ ID NO: 281 - DNA, 4747 bp, Homo sapiens
cggggcggggacagcccggcgggtctctcctcccccgcgccccgggcctccagaggggcgggaggggaccgtcccatataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccaggtaatagaaaaataagctgctatcctgagagtgacacttccaataagagtggggattagcatcttaatccccagatgcttaagggtgtcaactatatttgggatttaattccgatctcccagctgcactttccaaaaccaagaagtcaaagcagcgatttggacaaatgcttgctgttaacactgctttactgtctgtgcttcactgggatgctgtgtgttgcagcgagtatgtaatggagtggcagccatggctttaactctgtattgtctgctcacatggaagtatgactaaaacactgtcacgtgtctgtactcagtactgataggctcaaagtaatatggtaaatgcatcccatcagtacatttctgcccgattttacaatccatatcaatttccaacagctgcctataaaatagttttgtccctgtatgtgagcactgaaacagcatttggttgacacatctagtttttcatcttgcagtttcaaatccttctttttgaaaattggattttaaaaaaaagaagtaaaagtcacaccttcagggtgttctttcttgtggcttgaaagacaacattgc

SEQ ID NO: 282 - protein, 1284 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPGNRKISCYPESDTSNKSGD

SEQ ID NO: 283 - DNA, 5453 bp, Homo sapiens
cttgaggtgacagagacgaaactgattgtccttgagatgggactgcaatagaaatccgggcagcccgaagaggcacccagcgctccagccaccagctgggccgcccgggagtccctggctctagaccagccgcgaggaggcgccgcgagagagctggtccctgcccgcggccggaggagggctagagcccctgggccagccccccgagccggctgggcgggcgggcgggtgggagcagacgccgggcactgtcaccacgggtgcgccgagcgcaccgacccgggacacgggcagctggggaccgccagattccaccagccccccttgccccgcaggggtcctcggctcgcgctcctgggtagcagccacccaccggggcggagggagatgtcgcccggggccagccgcggtccccggggaagccaggcgccgctgatcgcgcccctctgctgcgccgcggccgcgctggggatgttgctgtggtcccccgcctgtcaggcgttcaacctggacgtggaaaagctcacagtgtacagcggccccaagggcagctacttcggctacgccgtggacttccacatacccgacgcccgcacagcgagtgtcttggtgggggcgcccaaagccaacaccagccagcccgatatcgtggaagggggagccgtctattactgtccttggcccgcggaggggtctgcgcagtgcaggcagataccgtttgacaccaccaacaacagaaagatcagagttaatggaaccaaagaacctatcgagttcaaatccaatcagtggtttggagcaacagtgaaagctcacaaaggaaaagttgtggcctgtgctcctttatatcactggagaactcttaaaccgacaccagaaaaggacccagttggcacctgctatgtagcaattcagaacttcagcgcctatgccgagttctctccttgccggaacagcaatgctgatccggaaggccagggttactgccaagcaggatttagtctggatttttataagaatggagaccttattgtgggaggacctgggagtttctactggcaaggacaagtgatcactgccagtgttgcagatatcattgcaaattactcattcaaggatatcctcaggaaactggcaggagaaaagcagacggaagtggctccagcttcctatgatgacagttaccttggatactcagttgctgctggggagtttactggggattctcagcaagaattggttgctggaattccaagaggagcacagaattttggatatgtttccatcattaactctacggatatgacgtttattcagaatttcacgggagaacagatggcatcttattttggatataccgttgtcgtatcagatgttaacagtgatggactggatgatgtcctggttggggcacctctctttatggaacgtgaatttgagagcaaccccagagaagtagggcaaatctacctgtatttgcaagtgagctctctcctcttcagagacccccagatcctcactggcaccgagacgtttgggagattcggtagtgctatggcacacttaggagacctgaaccaagatggatacaatgacattgccatcggagtgccttttgcaggcaaggatcaaagaggcaaagtgctcatttataatgggaacaaagatggcttaaacaccaagccttcccaagttctgcaaggagtgtgggcctcacatgctgtcccttccggatttggctttactttaagaggagattcagacatagacaagaatgattacccagatttgattgtgggtgcatttggaacaggaaaagtcgctgtttacagagcaagaccggttgtgactgtagatgcccagcttctgctgcacccaatgattatcaatcttgaaaataaaacttgccaggttccagactctatgacatctgctgcctgcttttctttaagagtatgtgcatctgtcacaggccagagcattgcaaacacaatagtcttgatggcagaggtgcaattagattccctgaaacagaaaggagctattaaacggacgctcttccttgataaccatcaggctcatcgcgtcttccctcttgtgataaaaaggcagaaatcccaccagtgccaggatttcatcgtttaccttcgagatgaaactgaattccgagataaattatctccaatcaacattagtttgaattacagtttggacgaatccacctttaaagaaggcctggaagtgaaaccaatattgaactactacagagaaaacattgttagtgaacagagataagcatcaggtaatcattggagatgaaaatcaccttatgctcataataaatgcaagaaatgaaggggaaggagcatatgaagctgaactctttgtaatgataccagaagaggcagattatgttggaatcgaacgcaacaacaagggatttcgaccactgagctgtgagtacaagatggaaaatgtaaccaggatggtggtgtgtgaccttgggaaccctatggtgtctggaacaaattattccctgggcctccgatttgcagttccacgtcttgagaaaacaaacatgagcattaacttcgatctccaaatcagaagttccaacaaggacaatccagacagcaattttgtgagcctgcaaatcaacatcactgctgtagcgcaggtggaaataagaggagtgtcacaccctccgcagattgttctgcccattcataactgggaaccagaagaggagccccacaaagaggaggaggttggaccattggtggaacatatttatgagctgcacaatattggaccaagtaccatcagtgacaccatcctggaggtgggctggcctttctctgcccgggatgaatttcttctctatattttccatattcaaactctgggacctctgcagtgccaaccaaatcctaatatcaatccacaggatataaagcctgctgcctccccagaggacacccctgagctcagcgcctttttgcgaaactctactattcctcatcttgtcaggaagagggatgtacatgtggtcgaattccacagacagagccctgcaaaaatactgaattgtacaaatatcgagtgtttacaaatctcctgtgcagtgggacgactcgaaggaggagaaagcgcagtcctgaaagtcaggtcacgattatgggcccacaccttcctccagagaaaaaatgatccctatgctcttgcatccctggtgtcctttgaagttaagaagatgccttatacagatcagccagcaaaactcccagaaggaagcatagcaattaagacatcagttatttgggcaactccgaatgtttccttctcaatcccattatgggtaataatactagcaatacttcttggattgttggttctcgccattttaaccttagctttatggaagtgtggattctttgacagagccagacctcctcaggaggacatgaccgacagggaacagctgacaaatgacaagacccctgaggcatgacaagaaaaaaaaagaagaccaaagacctcaaacactggtcctgttcaaagaaaaagaaagaacatgagggttaaaaatcaaagctttctgatacctgacagtgacccaggaaatggaggggaccctggaaacatcacctcatctacaccgcactttggagaaattgtcctgggtgcccagtgagccctgttggaaaaggaaacaccaaagctggagaagccatcagcaattgtggaagattttcttttgctttaatcgttctgtacttggcagacactttgaaatgcgtatgggaacgtaagttgcagtccagatcaatccagcataagttgcagagatgaaatgtctgaatcactatagaatttacaaggtgaactaaggtgaaatgactgatttactatagaacttagaactaagaccacaccatccaacactactgtatccaatggaacatttgacacctccctatggaaaagaaacatttctaaggacattatggctcagggagacaagcaatatgttgttggtactgtgaaagtacttttgaaaggacaaaaataatcttgtgagtgagggtgagagtttatttatttattttccatgtctctaggttgagaatctgtcatctagagaatttggaaattaagatttggttagctagttttcaaaatcactcactcagtttcctcctaagaaccactgtgtgcagataactcatttagcagagcttcttcagaatttagacagtgctaaggaaaggaagattggcattaggaatcagttctatttaataccttgctgccttccatctgaaattcctttcactcacattatccagggactcacatctgcttaatttagctttgcaagatgttgcatttatatttccttgtatatctttccattgacttagttaatacatgaatttcgaggtactctctacctttggagtgtttaaaagtcatggtaaaatgtctagagttcattaattaaaaagcaatttaacattatgggtaaacattatttttaatatctataagaagcaacacttcttatagatatttagcttgggattaaatacccgtttttcctgctatgccttgtacttgtatacacagagaaaacatgttgaatataacttagacaaaaacataaaattatacaggcatgagccaaactgggaaaactgattcctaaagatttttatttaaaattgcttattccaactttattacttatttttactgctaatctttataatatgtaactttggagaataatcttttatttaagctattttcccatcatcttgaatttaaccatcacaaattttttatgtttaaaactcttgtaaataattcataatcttgtaatattatcatttttgaagtaaaattgaccagccaaatttataggtagtctgcacaattttgtatccttttttaataatgaaaaattactatgaagaaatactgaacaaatttttatgtgcaatattttatagacctatgtatctgaagcatgtttacactggcgtttttttttttaattaatttcctaaatgttaagtatgatagaacaagctgacccaaatccttaagtttacaaagctgttggaaaactttgtgtcctgatttcaacaatcacgctttgtttgaaagatgagccaagctcacagacactaaattttatgtcatgccataagctggagaggagccatttggctacagctgcggaacttcattgaggagcaaatgaaaggcacatggacgagcacgctggtgcagttcatgttcttcctgcctgtgaattgaatactgtcctggtagcagtttcgggtcggtcaggagctcaaggctggtttgtgtggctgactacggatgagcactgaagttgcctcaaagaattaaggggtgtccacaccagcctctgggggtctttg

SEQ ID NO: 284 - protein, 635 aa, Homo sapiens
MSPGASRGPRGSQAPLIAPLCCAAAALGMLLWSPACQAFNLDVEKLTVYSGPKGSYFGYAVDFHIPDARTASVLVGAPKANTSQPDIVEGGAVYYCPWPAEGSAQCRQIPFDTTNNRKIRVNGTKEPIEFKSNQWFGATVKAHKGKVVACAPLYHWRTLKPTPEKDPVGTCYVAIQNFSAYAEFSPCRNSNADPEGQGYCQAGFSLDFYKNGDLIVGGPGSFYWQGQVITASVADIIANYSFKDILRKLAGEKQTEVAPASYDDSYLGYSVAAGEFTGDSQQELVAGIPRGAQNFGYVSIINSTDMTFIQNFTGEQMASYFGYTVVVSDVNSDGLDDVLVGAPLFMEREFESNPREVGQIYLYLQVSSLLFRDPQILTGTETFGRFGSAMAHLGDLNQDGYNDIAIGVPFAGKDQRGKVLIYNGNKDGLNTKPSQVLQGVWASHAVPSGFGFTLRGDSDIDKNDYPDLIVGAFGTGKVAVYRARPVVTVDAQLLLHPMIINLENKTCQVPDSMTSAACFSLRVCASVTGQSIANTIVLMAEVQLDSLKQKGAIKRTLFLDNHQAHRVFPLVIKRQKSHQCQDFIVYLRDETEFRDKLSPINISLNYSLDESTFKEGLEVKPILNYYRENIVSEQR

SEQ ID NO: 285 - protein, 297 aa, Homo sapiens
MQRARPTLWAAALTLLVLLRGPPVARAGASSGGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGEPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 286 - DNA, 2542 bp, Homo sapiens
cggcgcgcctgggtcggcagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggtgagccgcccgcgccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaa

SEQ ID NO: 287 - protein, 295 aa, Homo sapiens [sequence omitted]

SEQ ID NO: 288 - DNA, 2878 bp, Homo sapiens
cagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggagggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccagcggcgcgcctgggtcggcagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctgcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaa

SEQ ID NO: 289 - protein, 355 aa, Homo sapiens
MEKERETLQAWKERVGQELDRVVAFWMEHSHDQEHGGFFTCLGREGRVYDDLKYVWLQGRQVWMYCRLYRTFERFRHAQLLDAAKAGGEFLLRYARVAPPGKKCAFVLTRDGRPVKVQRTIFSECFYTMAMNELWRATGEVRYQTEAVEMMDQIVHWVQEDASGLGRPQLQGAPAAEPMAVPMMLLNLVEQLGEADEELAGKYAELGDWCARRILQHVQRDGQAVLENVSEGGKELPGCLGRQQNPGHTLEAGWFLLRHCIRKGDPELRAHVIDKFLLLPFHSGWDPDHGGLFYFQDADNFCPTQLEWAMKLWWPHSEAMIAFLMGYSDSGDPVLLRLFYQVAEYTFRQGLYRPG

SEQ ID NO: 290 - DNA, 1677 bp, Homo sapiens
gtggagggtcgcggcaggaacaagtgcgggggysgggctcaaagccccgccccaggcccagcggaaccctgaagaggagggggagggtgagccgggcgcggctgtgtcagctgagtgacagtcacgggaccgcgaccaactctgtctggcttcctagaggagcaggagggatgagcaagggtctcccagcgcgacaggacatggagaaagagcgagagactctgcaggcctggaaggagcgcgtggggcaggagctggaccgcgtggtggctttctggatggagcactcccacgaccaggagcacgggggcttcttcacgtgccttggccgcgaggggcgggtgtatgatgacctcaagtatgtgtggctgcaggggaggcaggtatggatgtattgtcgcctgtaccgcactttcgagcgcttccgccatgctcagcttctggacgcagcaaaagcaggtggtgagttcttgctgcggtatgcccgggtggcacctcctggcaagaagtgtgcctttgtgctgactcgggacggccgcccggtcaaggtgcagcgaaccatcttcagtgagtgtttctacaccatggccatgaacgagctgtggagagccacaggggaagtgcggtaccagacggaagcggtggagatgatggatcagatcgtccactgggtgcaggaggacgcgtcgggactgggccggccccagctccagggggccccggctgcggagcccatggcggtgcccatgatgctactgaacctggtggagcagctcggggaggcagatgaggagctggcgggcaaatacgcagagctgggggactggtgcgcccggaggattctgcagcacgtgcagagggatggacaagctgtgctggagaatgtgtcagagggtggcaaggaacttcctggctgcctggggagacagcagaacccaggccacacgctggaagccggctggtttctgctccgtcattgcattcggaaaggcgaccccgaacttcgagcccacgtgattgacaagttcctattgttgcccttccactccggatgggaccctgaccacggaggcctcttttacttccaggatgctgataacttctgccccacccagctggagtgggccatgaagctctggtggccacacagtgaagccatgattgccttcctcatgggttacagtgacagtggggaccctgtgctgctgcgcctcttctaccaagtggctgagtacaccttccgccagggtctctatcgcccaggctgagtgcagtggcacaatcatggctcagtgcagcctcaacctcctgggctcaagcgatccttccacctcagccacccaggctggagcgcaatggcgtgatctcagctcactgcaacctccgcctcctgtgttcaagctattctcccgcctcagcctcccgagtatactgctgggattacaatttcgcgatcccgagtacggggaatggtttggctacctgagccgagagggcaaggtggccctctccatcaagggaggtcctttcaaaggctgcttccacgtgccgcggtgcctagccatgtgcgaggagatgctgggcgccctgctgagccgccccgcccccgccccctcccccgcccccacccccgcctgccgaggcgcggaataaaggctgagtccgctccacctgcgg

SEQ ID NO: 291 - protein, 357 aa, Homo sapiens
MEKERETLQAWKERVGQELDRVVAFWMEHSHDQEHGGFFTCLGREGRVYDDLKYVWLQGRQVWMYCRLYRTFERFRHAQLLDAAKAGGEFLLRYARVAPPGKKCAFVLTRDGRPVKVQRTIFSECFYTMAMNELWRATGEVRYQTEAVEMMDQIVHWVQEDASGLGRPQLQGAPAAEPMAVPMMLLNLVEQLGEADEELAGKYAELGDWCARRILQHVQRDGQAVLENVSEGGKELPGCLGRQQNPGHTLEAGWFLLRHCIRKGDPELRAHVIDKFLLLPFHSGWDPDHGGLFYFQDADNFCPTQLEWAMKLWWPHSEAMIAFLMGYSDSGDPVLLRLFYQVAEYTFRQAASTCRGA

SEQ ID NO: 292 - DNA, 1166 bp, Homo sapiens
  misc_feature (1)..(1074): CDS
atggagaaagagcgagagactctgcaggcctggaaggagcgcgtggggcaggagctggaccgcgtggtggctttctggatggagcactcccacgaccaggagcacgggggcttcttcacgtgccttggccgcgaggggcgggtgtatgatgacctcaagtatgtgtggctgcaggggaggcaggtatggatgtattgtcgcctgtaccgcactttcgagcgcttccgccatgctcagcttctggacgcagcaaaagcaggtggtgagttcttgctgcggtatgcccgggtggcacctcctggcaagaagtgtgcctttgtgctgactcgggacggccgcccggtcaaggtgcagcgaaccatcttcagtgagtgtttctacaccatggccatgaacgagctgtggagagccacaggggaagtgcggtaccagacggaagcggtggagatgatggatcagatcgtccactgggtgcaggaggacgcgtcgggactgggccggccccagctccagggggccccggctgcggagcccatggcggtgcccatgatgctactgaacctggtggagcagctcggggaggcagatgaggagctggcgggcaaatacgcagagctgggggactggtgcgcccggaggattctgcagcacgtgcagagggatggacaagctgtgctggagaatgtgtcagagggtggcaaggaacttcctggctgcctggggagacagcagaacccaggccacacgctggaagccggctggtttctgctccgtcattgcattcggaaaggcgaccccgaacttcgagcccacgtgattgacaagttcctattgttgcccttccactccggatgggaccctgaccacggaggcctcttttacttccaggatgctgataacttctgccccacccagctggagtgggccatgaagctctggtggccacacagtgaagccatgattgccttcctcatgggttacagtgacagtggggaccctgtgctgctgcgcctcttctaccaagtggctgagtacaccttccgccaggctgcttccacgtgccgcggtgcctagccatgtgcgaggagatgctgggcgccctgctgagccgccccgcccccgccccctcccccgcccccacccccgcctgccgaggcgcggaataa

SEQ ID NO: 293 - protein, 229 aa, Homo sapiens
MEKERETLQAWKERVGQELDRVVAFWMEHSHDQEHGGFFTCLGREGRVYDDLKYVWLQGRQVWMYCRLYRTFERFRHAQLLDAAKAGGEFLLRYARVAPPGKKCAFVLTRDGRPVKVQRTIFSECFYTMAMNELWRATGEVRYQTEAVEMMDQIVHWVQEDASGLGRPQLQGAPAAEPMAVPMMLLNLVEQLGEADEELAGKYAELGDWCARRILQHVQARAGRGGSCL

SEQ ID NO: 294 - DNA, 1154 bp, Homo sapiens
gtggagggtcgcggcaggaacaagtgcgggggysgggctcaaagccccgccccaggcccagcggaaccctgaagaggagggggagggtgagccgggcgcggctgtgtcagctgagtgacagtcacgggaccgcgaccaactctgtctggcttcctagaggagcaggagggatgagcaagggtctcccagcgcgacaggacatggagaaagagcgagagactctgcaggcctggaaggagcgcgtggggcaggagctggaccgcgtggtggctttctggatggagcactcccacgaccaggagcacgggggcttcttcacgtgccttggccgcgaggggcgggtgtatgatgacctcaagtatgtgtggctgcaggggaggcaggtatggatgtattgtcgcctgtaccgcactttcgagcgcttccgccatgctcagcttctggacgcagcaaaagcaggtggtgagttcttgctgcggtatgcccgggtggcacctcctggcaagaagtgtgcctttgtgctgactcgggacggccgcccggtcaaggtgcagcgaaccatcttcagtgagtgtttctacaccatggccatgaacgagctgtggagagccacaggggaagtgcggtaccagacggaagcggtggagatgatggatcagatcgtccactgggtgcaggaggacgcgtcgggactgggccggccccagctccagggggccccggctgcggagcccatggcggtgcccatgatgctactgaacctggtggagcagctcggggaggcagatgaggagctggcgggcaaatacgcagagctgggggactggtgcgcccggaggattctgcagcacgtgcaggcccgggctggacgcggtggctcgtgcctgtaatcccagcagtttgggaggctgaggcgggcggatcacctgaggtcaggagttggagaccagcctggccaatatagtgaaaccccgtctctactaaaaatacaaaaattagctgggcatggtggtgcatgcctgtaatcccagcctctagggaggctgaggcaggagaatcgcatgaacccaggaggtggagattgtagtgagtcgagattgcggccactgcactttagcctgggtgacagagcaagactctgtctaaaaaaaaaa

SEQ ID NO: 295 - protein, 229 aa, Homo sapiens
MEKERETLQAWKERVGQELDRVVAFWMEHSHDQEHGGFFTCLGREGRVYDDLKYVWLQGRQVWMYCRLYRTFERFRHAQLLDAAKAGGEFLLRYARVAPPGKKCAFVLTRDGRPVKVQRTIFSECFYTMAMNELWRATGEVRYQEDASGLGRPQLQGAPAAEPMAVPMMLLNLVEQLGEADEELAGKYAELGDWCARRILQHVQATRWKPAGFCSVIAFGKATPNFEPT

SEQ ID NO: 296 - DNA, 1453 bp, Homo sapiens
gtggagggtcgcggcaggaacaagtgcgggggysgggctcaaagccccgccccaggcccagcggaaccctgaagaggagggggagggtgagccgggcgcggctgtgtcagctgagtgacagtcacgggaccgcgaccaactctgtctggcttcctagaggagcaggagggatgagcaagggtctcccagcgcgacaggacatggagaaagagcgagagactctgcaggcctggaaggagcgcgtggggcaggagctggaccgcgtggtggctttctggatggagcactcccacgaccaggagcacgggggcttcttcacgtgccttggccgcgaggggcgggtgtatgatgacctcaagtatgtgtggctgcaggggaggcaggtatggatgtattgtcgcctgtaccgcactttcgagcgcttccgccatgctcagcttctggacgcagcaaaagcaggtggtgagttcttgctgcggtatgcccgggtggcacctcctggcaagaagtgtgcctttgtgctgactcgggacggccgcccggtcaaggtgcagcgaaccatcttcagtgagtgtttctacaccatggccatgaacgagctgtggagagccacaggggaagtgcggtaccaggaggacgcgtcgggactgggccggccccagctccagggggccccggctgcggagcccatggcggtgcccatgatgctactgaacctggtggagcagctcggggaggcagatgaggagctggcgggcaaatacgcagagctgggggactggtgcgcccggaggattctgcagcacgtgcaggccacacgctggaagccggctggtttctgctccgtcattgcattcggaaaggcgaccccgaacttcgagcccacgtgattgacaagttcctattgttgcccttccactccggatgggaccctgaccacggaggcctcttttacttccaggatgctgataacttctgccccacccagctggagtgggccatgaagctctggtggccacacagtgaagccatgattgccttcctcatgggttacagtgacagtggggaccctgtgctgctgcgcctcttctaccaagtggctgagtacaccttccgccaggctggagcgcaatggcgtgatctcagctcactgcaacctccgcctcctgtgttcaagctattctcccgcctcagcctcccgagtatactgctgggattacaatttcgcgatcccgagtacggggaatggtttggctacctgagccgagagggcaaggtggccctctccatcaagggaggtcctttcaaaggctgcttccacgtgccgcggtgcctagccatgtgcgaggagatgctgggcgccctgctgagccgccccgcccccgccccctcccccgcccccacccccgcctgccgaggcgcggaataaaggctgagtccgctccacctgcgg

SEQ ID NO: 297 - protein, 451 aa, Homo sapiens
MEKERETLQAWKERVGQELDRVVAFWMEHSHDQEHGGFFTCLGREGRVYDDLKYVWLQGRQVWMYCRLYRTFERFRHAQLLDAAKAGGEFLLRYARVAPPGKKCAFVLTRDGRPVKVQRTIFSECFYTMAMNELWRATGEVRYQTEAVEMMDQIVHWVQEDASGLGRPQLQGAPAAEPMAVPMMLLNLVEQLGEADEELAGKYAELGDWCARRILQHVQRDGQAVLENVSEGGKELPGCLGRQQNPGHTLEAGWFLLRHCIRKGDPELRAHVIDKFLLLPFHSGWDPDHGGLFYFQDADNFCPTQLEWAMKLWWPHSEAMIAFLMGYSDSGDPVLLRLFYQVAEYTFRQAGAQWRDLSSLQPPPPVFKLFSRLSLPSILLGLQFRDPEYGEWFGYLSREGKVALSIKGGPFKGCFHVPRCLAMCEEMLGALLSRPAPAPSPAPTPACRGAE

SEQ ID NO: 298 - DNA, 1580 bp, Homo sapiens
  misc_feature (201)..(1556): CDS
gtggagggtcgcggcaggaacaagtgcgggggysgggctcaaagccccgccccaggcccagcggaaccctgaagaggagggggagggtgagccgggcgcggctgtgtcagctgagtgacagtcacgggaccgcgaccaactctgtctggcttcctagaggagcaggagggatgagcaagggtctcccagcgcgacaggacatggagaaagagcgagagactctgcaggcctggaaggagcgcgtggggcaggagctggaccgcgtggtggctttctggatggagcactcccacgaccaggagcacgggggcttcttcacgtgccttggccgcgaggggcgggtgtatgatgacctcaagtatgtgtggctgcaggggaggcaggtatggatgtattgtcgcctgtaccgcactttcgagcgcttccgccatgctcagcttctggacgcagcaaaagcaggtggtgagttcttgctgcggtatgcccgggtggcacctcctggcaagaagtgtgcctttgtgctgactcgggacggccgcccggtcaaggtgcagcgaaccatcttcagtgagtgtttctacaccatggccatgaacgagctgtggagagccacaggggaagtgcggtaccagacggaagcggtggagatgatggatcagatcgtccactgggtgcaggaggacgcgtcgggactgggccggccccagctccagggggccccggctgcggagcccatggcggtgcccatgatgctactgaacctggtggagcagctcggggaggcagatgaggagctggcgggcaaatacgcagagctgggggactggtgcgcccggaggattctgcagcacgtgcagagggatggacaagctgtgctggagaatgtgtcagagggtggcaaggaacttcctggctgcctggggagacagcagaacccaggccacacgctggaagccggctggtttctgctccgtcattgcattcggaaaggcgaccccgaacttcgagcccacgtgattgacaagttcctattgttgcccttccactccggatgggaccctgaccacggaggcctcttttacttccaggatgctgataacttctgccccacccagctggagtgggccatgaagctctggtggccacacagtgaagccatgattgccttcctcatgggttacagtgacagtggggaccctgtgctgctgcgcctcttctaccaagtggctgagtacaccttccgccaggctggagcgcaatggcgtgatctcagctcactgcaacctccgcctcctgtgttcaagctattctcccgcctcagcctcccgagtatactgctgggattacaatttcgcgatcccgagtacggggaatggtttggctacctgagccgagagggcaaggtggccctctccatcaagggaggtcctttcaaaggctgcttccacgtgccgcggtgcctagccatgtgcgaggagatgctgggcgccctgctgagccgccccgcccccgccccctcccccgcccccacccccgcctgccgaggcgcggaataaaggctgagtccgctccacctgcgg

SEQ ID NO: 299 - protein, 87 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKLH

SEQ ID NO: 300 - DNA, 5815 bp, Homo sapiens
gagggagttcagacctagatctttccagttaatcacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgctgacaatactatgaatgacactgatgttcctttggaaacaactgaatgcatccaaggtcaaggagaaggctacaggggcactgtcaataccatttggaatggaattccatgtcagcgttgggattctcagtatcctcacgagcatgacatgactcctgaaaatttcaagtgcaaggacctacgagaaaattactgccgaaatccagatgggtctgaatcaccctggtgttttaccactgatccaaacatccgagttggctactgctcccaaattccaaactgtgatatgtcacatggacaagattgttatcgtgggaatggcaaaaattatatgggcaacttatcccaaacaagatctggactaacatgttcaatgtgggacaagaacatggaagacttacatcgtcatatcttctgggaaccagatgcaagtaagctgaatgagaattactgccgaaatccagatgatgatgctcatggaccctggtgctacacgggaaatccactcattccttgggattattgccctatttctcgttgtgaaggtgataccacacctacaatagtcaatttagaccatcccgtaatatcttgtgccaaaacgaaacaattgcgagttgtaaatgggattccaacacgaacaaacataggatggatggttagtttgagatacagaaataaacatatctgcggaggatcattgataaaggagagttgggttcttactgcacgacagtgtttcccttctcgagacttgaaagattatgaagcttggcttggaattcatgatgtccacggaagaggagatgagaaatgcaaacaggttctcaatgtttcccagctggtatatggccctgaaggatcagatctggttttaatgaagcttgccaggcctgctgtcctggatgattttgttagtacgattgatttacctaattatggatgcacaattcctgaaaagaccagttgcagtgtttatggctggggctacactggattgatcaactatgatggcctattacgagtggcacatctctatataatgggaaatgagaaatgcagccagcatcatcgagggaaggtgactctgaatgagtctgaaatatgtgctggggctgaaaagattggatcaggaccatgtgagggggattatggtggcccacttgtttgtgagcaacataaaatgagaatggttcttggtgtcattgttcctggtcgtggatgtgccattccaaatcgtcctggtatttttgtccgagtagcatattatgcaaaatggatacacaaaattattttaacatataaggtaccacagtcatagctgaagtaagtgtgtctgaagcacccaccaatacaactgtcttttacatgaagatttcagagaatgtggaatttaaaatgtcacttacaacaatcctaagacaactactggagagtcatgtttgttgaaattctcattaatgtttatgggtgttttctgttgttttgtttgtcagtgttattttgtcaatgttgaagtgaattaaggtacatgcaagtgtaataacatatctcctgaagatacttgaatggattaaaaaaacacacaggtatatttgctggatgataaagatttcatgggaaaaaaaatcaattaatctgtctaagctgctttctgatgttggtttcttaataatgagtaaaccacaaattaaatgttattttaacctcaccaaaacaatttataccttgtgtccctaaattgtagccctatattaaattatattacatttcatatgctatatgttatagttcattcatttctcttcaccatgtatcctgcaatactggtacacgaacacactttttacaaaaccacatacccatgtacacatgcctaggtacacatgtacatgcactacagtttaaattatgatgtacttaatgtaacctctaaatattttagaagtatgtacctatagttttacctcaaaaaaatagaaatctctaaagaccagtagaaatattaaaaaatgatgcaaaatcaaaatgagtggctaattctccatacgtaatctgcagatgatcttctctggttgacattttacgtgtggccatcaccccgggttaaataacacctaatctaggtgtttacatgtattcaatatcctagtttgtttcatgtagtttctaattcttaaaggaaagagggtaataattctatttgtgtaatttgtttcctccaaacttaaggccacttatttacacaagatatttgtatgtctactttcctaaagcatttcttcagtgctcagatcagtgtctaattgaagaagattaaaactgctttggtcattaaaaacgtatttaaataggttaattctaagacttgctgctgtgattgacttctagctcactgcctttaaattttaaaaaatttaagaggaaaattttcatgtctccaaagttttataaatacccttcatcaagtcatgcattaaagtatatattagagaaaaaaaaatacttttctcaacctggaagattttagcctaataaagtttttttgaagtaaaagaaaacttgtaaagggaaagaaactagtttgtctaaactctgtattcattttttttttttttgaagtacagtggaatctgttgaatcagatattttatcaagatatctttattttttcttatttcatttttacaaagatcactcccaatgccatatgtaatagacatttaaatttcgtgttctgtataacagccaaattatcatatttatcattgtatttgtcatgcttagctaaagatcatgtatttgttgagaaatagaataacaaaaagtaataggataggctttgaatttttgcagaaatcttcctgtacaaaacacctttaaaaataattttttgaatggtgtgaatccagtagtcccatttctctgacttagttttcttgagtgatttttatcaaggccaagtccccaaacaattccctaccagctctttagagtactgttcaatctggactaaaatggttttaagtttatggagagcttagtccacagaatatagggcggcgagtccagaaatgcttatacaatttttttttcataataagatatgtgctggcatcaagaaacttaaagtggaagcaaaaagacatccaactagttgctggtctctatcatcttatctgatggtatttctattttccttatataatacaccattttagtaagaactcctagaaatttcaagagcatattgccaaaatataaagtatatttcatagtttcttctggctgaaccagtgaaattttattattgcatattaatgatatttgtaaaacttttataaaaattgtcataattttaaatactcacattttaaaaatacttctttaatgactcttcctctaaatttcctggaaatacagataaagattagctagatacaagatacagctaagtatttagacattttgaggctagtatttttcattttattaaaggctaaaaacaataccaccaataaatcatcaaacaaaccgtacaaagtaattctctctttgggaggctcctttcgtgatagagggacatgggtggaattgacaatgaaagttagatgaacaaggtccgtgttattttaggtagtagaacagggtagagtcatgtcattatttgcgggcggaagacactatttaccaggtgttctttgctgaataaatcattaaacatttttaaaaatccaattatccactttattttgtgtcattgacaaaaggatcttttaagtcagaaggtttcaatgtgatttttggcttggctgtttgaataatggttatgtactgttataattgtagacattttctcacgtctaccaggaattgaagtgtaaaactaaaatatttttcataatgcctctgccgtgcagaaggaatgataatccttttgtatacttctttaattttattgtaaaatgtgtaatgacttttacctatatgctgtgggcaggtcctcagtaaaatctattgagtcaatttctagtattaacaggcttttgcttgctatctaagtgtttcaaattatgggaagtgtgagacactggaaggcaagaaaattaacaataatggcatgtgatagcaaaattgtatttcacttattcctgtgaatatttcttgttggtaccaatggtactgtacaaagtgaatgttatagccacaacattctcttgaaaagaacactgtcaagaagtgggaaattgctgtcaggcatttcattgttgtttttaaacttttttaaaagaaatactggttttgcaatatagagatcatgtggtaaagaattttaataagatcttatactaaaaagccttaaatcaatttattgagattcaaaaaatactattataattaattacatcccatacatataggcaaactcatttaaaaaataaaactaattttggtaaaagtacatggcctttgtttttaaaatacataattttaaaataaatcacttgtcatgataaagtccaaaaagaagttatcattcaacattcaactaaggttggagctaagaatttactaatacaaaaaaagttaaaattttttggaccatatatatcttgacagtgtaacttttaagtaggttcatttccatttgcacagaaagtttctgtctttaggaaactgaaaatgaaatactgtggatgctatgactgtttgtcttgtatgtaaataggaaaataataagctgcctattgagtggtatagctgtatgcttacccaaaaaagggaacactgtggttatgacttgtattataaactttctgtagttaataaagttgttatttttataaccatgattatattattattattaataaaatattttatcaaaatgctta

SEQ ID NO: 301 - protein, 173 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKAFCLRAIGVKTYRKTTVEILEGKKGDPGVSQAIQRYATKSVTFLSVQKLNA

SEQ ID NO: 302 - DNA, 5813 bp, Homo sapiens
gagggagttcagacctagatctttccagttaatcacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgctgacaatactatgaatgacactgatgttcctttggaaacaactgaatgcatccaaggtcaaggagaaggctacaggggcactgtcaataccatttggaatggaattccatgtcagcgttgggattctcagtatcctcacgagcatgacatgactcctgaaaatttcaagtgcaaggacctacgagaaaattactgccgaaatccagatgggtctgaatcaccctggtgttttaccactgatccaaacatccgagttggctactgctcccaaattccaaactgtgatatgtcacatggacaagattgttatcgtgggaatggcaaaaattatatgggcaacttatcccaaacaagatctggactaacatgttcaatgtgggacaagaacatggaagacttacatcgtcatatcttctgggaaccagatgcaagtaagctgaatgagaattactgccgaaatccagatgatgatgctcatggaccctggtgctacacgggaaatccactcattccttgggattattgccctatttctcgttgtgaaggtgataccacacctacaatagtcaatttagaccatcccgtaatatcttgtgccaaaacgaaacaattgcgagttgtaaatgggattccaacacgaacaaacataggatggatggttagtttgagatacagaaataaacatatctgcggaggatcattgataaaggagagttgggttcttactgcacgacagtgtttcccttctcgagacttgaaagattatgaagcttggcttggaattcatgatgtccacggaagaggagatgagaaatgcaaacaggttctcaatgtttcccagctggtatatggccctgaaggatcagatctggttttaatgaagcttgccaggcctgctgtcctggatgattttgttagtacgattgatttacctaattatggatgcacaattcctgaaaagaccagttgcagtgtttatggctggggctacactggattgatcaactatgatggcctattacgagtggcacatctctatataatgggaaatgagaaatgcagccagcatcatcgagggaaggtgactctgaatgagtctgaaatatgtgctggggctgaaaagattggatcaggaccatgtgagggggattatggtggcccacttgtttgtgagcaacataaaatgagaatggttcttggtgtcattgttcctggtcgtggatgtgccattccaaatcgtcctggtatttttgtccgagtagcatattatgcaaaatggatacacaaaattattttaacatataaggtaccacagtcatagctgaagtaagtgtgtctgaagcacccaccaatacaactgtcttttacatgaagatttcagagaatgtggaatttaaaatgtcacttacaacaatcctaagacaactactggagagtcatgtttgttgaaattctcattaatgtttatgggtgttttctgttgttttgtttgtcagtgttattttgtcaatgttgaagtgaattaaggtacatgcaagtgtaataacatatctcctgaagatacttgaatggattaaaaaaacacacaggtatatttgctggatgataaagatttcatgggaaaaaaaatcaattaatctgtctaagctgctttctgatgttggtttcttaataatgagtaaaccacaaattaaatgttattttaacctcaccaaaacaatttataccttgtgtccctaaattgtagccctatattaaattatattacatttcatatgctatatgttatagttcattcatttctcttcaccatgtatcctgcaatactggtacacgaacacactttttacaaaaccacatacccatgtacacatgcctaggtacacatgtacatgcactacagtttaaattatgatgtacttaatgtaacctctaaatattttagaagtatgtacctatagttttacctcaaaaaaatagaaatctctaaagaccagtagaaatattaaaaaatgatgcaaaatcaaaatgagtggctaattctccatacgtaatctgcagatgatcttctctggttgacattttacgtgtggccatcaccccgggttaaataacacctaatctaggtgtttacatgtattcaatatcctagtttgtttcatgtagtttctaattcttaaaggaaagagggtaataattctatttgtgtaatttgtttcctccaaacttaaggccacttatttacacaagatatttgtatgtctactttcctaaagcatttcttcagtgctcagatcagtgtctaattgaagaagattaaaactgctttggtcattaaaaacgtatttaaataggttaattctaagacttgctgctgtgattgacttctagctcactgcctttaaattttaaaaaatttaagaggaaaattttcatgtctccaaagttttataaatacccttcatcaagtcatgcattaaagtatatattagagaaaaaaaaatacttttctcaacctggaagattttagcctaataaagtttttttgaagtaaaagaaaacttgtaaagggaaagaaactagtttgtctaaactctgtattcattttttttttttttgaagtacagtggaatctgttgaatcagatattttatcaagatatctttattttttcttatttcatttttacaaagatcactcccaatgccatatgtaatagacatttaaatttcgtgttctgtataacagccaaattatcatatttatcattgtatttgtcatgcttagctaaagatcatgtatttgttgagaaatagaataacaaaaagtaataggataggctttgaatttttgcagaaatcttcctgtacaaaacacctttaaaaataattttttgaatggtgtgaatccagtagtcccatttctctgacttagttttcttgagtgatttttatcaaggccaagtccccaaacaattccctaccagctctttagagtactgttcaatctggactaaaatggttttaagtttatggagagcttagtccacagaatatagggcggcgagtccagaaatgcttatacaatttttttttcataataagatatgtgctggcatcaagaaacttaaagtggaagcaaaaagacatccaactagttgctggtctctatcatcttatctgatggtatttctattttccttatataatacaccattttagtaagaactcctagaaatttcaagagcatattgccaaaatataaagtatatttcatagtttcttctggctgaaccagtgaaattttattattgcatattaatgatatttgtaaaacttttataaaaattgtcataattttaaatactcacattttaaaaatacttctttaatgactcttcctctaaatttcctggaaatacagataaagattagctagatacaagatacagctaagtatttagacattttgaggctagtatttttcattttattaaaggctaaaaacaataccaccaataaatcatcaaacaaaccgtacaaagtaattctctctttgggaggctcctttcgtgatagagggacatgggtggaattgacaatgaaagttagatgaacaaggtccgtgttattttaggtagtagaacagggtagagtcatgtcattatttgcgggcggaagacactatttaccaggtgttctttgctgaataaatcattaaacatttttaaaaatccaattatccactttattttgtgtcattgacaaaaggatcttttaagtcagaaggtttcaatgtgatttttggcttggctgtttgaataatggttatgtactgttataattgtagacattttctcacgtctaccaggaattgaagtgtaaaactaaaatatttttcataatgcctctgccgtgcagaaggaatgataatccttttgtatacttctttaattttattgtaaaatgtgtaatgacttttacctatatgctgtgggcaggtcctcagtaaaatctattgagtcaatttctagtattaacaggcttttgcttgctatctaagtgtttcaaattatgggaagtgtgagacactggaaggcaagaaaattaacaataatggcatgtgatagcaaaattgtatttcacttattcctgtgaatatttcttgttggtaccaatggtactgtacaaagtgaatgttatagccacaacattctcttgaaaagaacactgtcaagaagtgggaaattgctgtcaggcatttcattgttgtttttaaacttttttaaaagaaatactggttttgcaatatagagatcatgtggtaaagaattttaataagatcttatactaaaaagccttaaatcaatttattgagattcaaaaaatactattataattaattacatcccatacatataggcaaactcatttaaaaaataaaactaattttggtaaaagtacatggcctttgtttttaaaatacataattttaaaataaatcacttgtcatgataaagtccaaaaagaagttatcattcaacattcaactaaggttggagctaagaatttactaatacaaaaaaagttaaaattttttggaccatatatatcttgacagtgtaacttttaagtaggttcatttccatttgcacagaaagtttctgtctttaggaaactgaaaatgaaatactgtggatgctatgactgtttgtcttgtatgtaaataggaaaataataagctgcctattgagtggtatagctgtatgcttacccaaaaaagggaacactgtggttatgacttgtattataaactttctgtagttaataaagttgttatttttataaccatgattatattattattattaataaaatattttatcaaaatgctta

SEQ ID NO: 303 - protein, 249 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPES

SEQ ID NO: 304 - DNA, 5809 bp, Homo sapiens
gagggagttcagacctagatctttccagttaatcacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagctgacaatactatgaatgacactgatgttcctttggaaacaactgaatgcatccaaggtcaaggagaaggctacaggggcactgtcaataccatttggaatggaattccatgtcagcgttgggattctcagtatcctcacgagcatgacatgactcctgaaaatttcaagtgcaaggacctacgagaaaattactgccgaaatccagatgggtctgaatcaccctggtgttttaccactgatccaaacatccgagttggctactgctcccaaattccaaactgtgatatgtcacatggacaagattgttatcgtgggaatggcaaaaattatatgggcaacttatcccaaacaagatctggactaacatgttcaatgtgggacaagaacatggaagacttacatcgtcatatcttctgggaaccagatgcaagtaagctgaatgagaattactgccgaaatccagatgatgatgctcatggaccctggtgctacacgggaaatccactcattccttgggattattgccctatttctcgttgtgaaggtgataccacacctacaatagtcaatttagaccatcccgtaatatcttgtgccaaaacgaaacaattgcgagttgtaaatgggattccaacacgaacaaacataggatggatggttagtttgagatacagaaataaacatatctgcggaggatcattgataaaggagagttgggttcttactgcacgacagtgtttcccttctcgagacttgaaagattatgaagcttggcttggaattcatgatgtccacggaagaggagatgagaaatgcaaacaggttctcaatgtttcccagctggtatatggccctgaaggatcagatctggttttaatgaagcttgccaggcctgctgtcctggatgattttgttagtacgattgatttacctaattatggatgcacaattcctgaaaagaccagttgcagtgtttatggctggggctacactggattgatcaactatgatggcctattacgagtggcacatctctatataatgggaaatgagaaatgcagccagcatcatcgagggaaggtgactctgaatgagtctgaaatatgtgctggggctgaaaagattggatcaggaccatgtgagggggattatggtggcccacttgtttgtgagcaacataaaatgagaatggttcttggtgtcattgttcctggtcgtggatgtgccattccaaatcgtcctggtatttttgtccgagtagcatattatgcaaaatggatacacaaaattattttaacatataaggtaccacagtcatagctgaagtaagtgtgtctgaagcacccaccaatacaactgtcttttacatgaagatttcagagaatgtggaatttaaaatgtcacttacaacaatcctaagacaactactggagagtcatgtttgttgaaattctcattaatgtttatgggtgttttctgttgttttgtttgtcagtgttattttgtcaatgttgaagtgaattaaggtacatgcaagtgtaataacatatctcctgaagatacttgaatggattaaaaaaacacacaggtatatttgctggatgataaagatttcatgggaaaaaaaatcaattaatctgtctaagctgctttctgatgttggtttcttaataatgagtaaaccacaaattaaatgttattttaacctcaccaaaacaatttataccttgtgtccctaaattgtagccctatattaaattatattacatttcatatgctatatgttatagttcattcatttctcttcaccatgtatcctgcaatactggtacacgaacacactttttacaaaaccacatacccatgtacacatgcctaggtacacatgtacatgcactacagtttaaattatgatgtacttaatgtaacctctaaatattttagaagtatgtacctatagttttacctcaaaaaaatagaaatctctaaagaccagtagaaatattaaaaaatgatgcaaaatcaaaatgagtggctaattctccatacgtaatctgcagatgatcttctctggttgacattttacgtgtggccatcaccccgggttaaataacacctaatctaggtgtttacatgtattcaatatcctagtttgtttcatgtagtttctaattcttaaaggaaagagggtaataattctatttgtgtaatttgtttcctccaaacttaaggccacttatttacacaagatatttgtatgtctactttcctaaagcatttcttcagtgctcagatcagtgtctaattgaagaagattaaaactgctttggtcattaaaaacgtatttaaataggttaattctaagacttgctgctgtgattgacttctagctcactgcctttaaattttaaaaaatttaagaggaaaattttcatgtctccaaagttttataaatacccttcatcaagtcatgcattaaagtatatattagagaaaaaaaaatacttttctcaacctggaagattttagcctaataaagtttttttgaagtaaaagaaaacttgtaaagggaaagaaactagtttgtctaaactctgtattcattttttttttttttgaagtacagtggaatctgttgaatcagatattttatcaagatatctttattttttcttatttcatttttacaaagatcactcccaatgccatatgtaatagacatttaaatttcgtgttctgtataacagccaaattatcatatttatcattgtatttgtcatgcttagctaaagatcatgtatttgttgagaaatagaataacaaaaagtaataggataggctttgaatttttgcagaaatcttcctgtacaaaacacctttaaaaataattttttgaatggtgtgaatccagtagtcccatttctctgacttagttttcttgagtgatttttatcaaggccaagtccccaaacaattccctaccagctctttagagtactgttcaatctggactaaaatggttttaagtttatggagagcttagtccacagaatatagggcggcgagtccagaaatgcttatacaatttttttttcataataagatatgtgctggcatcaagaaacttaaagtggaagcaaaaagacatccaactagttgctggtctctatcatcttatctgatggtatttctattttccttatataatacaccattttagtaagaactcctagaaatttcaagagcatattgccaaaatataaagtatatttcatagtttcttctggctgaaccagtgaaattttattattgcatattaatgatatttgtaaaacttttataaaaattgtcataattttaaatactcacattttaaaaatacttctttaatgactcttcctctaaatttcctggaaatacagataaagattagctagatacaagatacagctaagtatttagacattttgaggctagtatttttcattttattaaaggctaaaaacaataccaccaataaatcatcaaacaaaccgtacaaagtaattctctctttgggaggctcctttcgtgatagagggacatgggtggaattgacaatgaaagttagatgaacaaggtccgtgttattttaggtagtagaacagggtagagtcatgtcattatttgcgggcggaagacactatttaccaggtgttctttgctgaataaatcattaaacatttttaaaaatccaattatccactttattttgtgtcattgacaaaaggatcttttaagtcagaaggtttcaatgtgatttttggcttggctgtttgaataatggttatgtactgttataattgtagacattttctcacgtctaccaggaattgaagtgtaaaactaaaatatttttcataatgcctctgccgtgcagaaggaatgataatccttttgtatacttctttaattttattgtaaaatgtgtaatgacttttacctatatgctgtgggcaggtcctcagtaaaatctattgagtcaatttctagtattaacaggcttttgcttgctatctaagtgtttcaaattatgggaagtgtgagacactggaaggcaagaaaattaacaataatggcatgtgatagcaaaattgtatttcacttattcctgtgaatatttcttgttggtaccaatggtactgtacaaagtgaatgttatagccacaacattctcttgaaaagaacactgtcaagaagtgggaaattgctgtcaggcatttcattgttgtttttaaacttttttaaaagaaatactggttttgcaatatagagatcatgtggtaaagaattttaataagatcttatactaaaaagccttaaatcaatttattgagattcaaaaaatactattataattaattacatcccatacatataggcaaactcatttaaaaaataaaactaattttggtaaaagtacatggcctttgtttttaaaatacataattttaaaataaatcacttgtcatgataaagtccaaaaagaagttatcattcaacattcaactaaggttggagctaagaatttactaatacaaaaaaagttaaaattttttggaccatatatatcttgacagtgtaacttttaagtaggttcatttccatttgcacagaaagtttctgtctttaggaaactgaaaatgaaatactgtggatgctatgactgtttgtcttgtatgtaaataggaaaataataagctgcctattgagtggtatagctgtatgcttacccaaaaaagggaacactgtggttatgacttgtattataaactttctgtagttaataaagttgttatttttataaccatgattatattattattattaataaaatattttatcaaaatgctta

SEQ ID NO: 305 - protein, 390 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKLLSWEWQKLYGQLIPNKIWTNMFNVGQEHGRLTSSYLLGTRCK

SEQ ID NO: 306 - DNA, 5800 bp, Homo sapiens
gagggagttcagacctagatctttccagttaatcacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgctgacaatactatgaatgacactgatgttcctttggaaacaactgaatgcatccaaggtcaaggagaaggctacaggggcactgtcaataccatttggaatggaattccatgtcagcgttgggattctcagtatcctcacgagcatgacatgactcctgaaaatttcaagtgcaaattgttatcgtgggaatggcaaaaattatatgggcaacttatcccaaacaagatctggactaacatgttcaatgtgggacaagaacatggaagacttacatcgtcatatcttctgggaaccagatgcaagtaagctgaatgagaattactgccgaaatccagatgatgatgctcatggaccctggtgctacacgggaaatccactcattccttgggattattgccctatttctcgttgtgaaggtgataccacacctacaatagtcaatttagaccatcccgtaatatcttgtgccaaaacgaaacaattgcgagttgtaaatgggattccaacacgaacaaacataggatggatggttagtttgagatacagaaataaacatatctgcggaggatcattgataaaggagagttgggttcttactgcacgacagtgtttcccttctcgagacttgaaagattatgaagcttggcttggaattcatgatgtccacggaagaggagatgagaaatgcaaacaggttctcaatgtttcccagctggtatatggccctgaaggatcagatctggttttaatgaagcttgccaggcctgctgtcctggatgattttgttagtacgattgatttacctaattatggatgcacaattcctgaaaagaccagttgcagtgtttatggctggggctacactggattgatcaactatgatggcctattacgagtggcacatctctatataatgggaaatgagaaatgcagccagcatcatcgagggaaggtgactctgaatgagtctgaaatatgtgctggggctgaaaagattggatcaggaccatgtgagggggattatggtggcccacttgtttgtgagcaacataaaatgagaatggttcttggtgtcattgttcctggtcgtggatgtgccattccaaatcgtcctggtatttttgtccgagtagcatattatgcaaaatggatacacaaaattattttaacatataaggtaccacagtcatagctgaagtaagtgtgtctgaagcacccaccaatacaactgtcttttacatgaagatttcagagaatgtggaatttaaaatgtcacttacaacaatcctaagacaactactggagagtcatgtttgttgaaattctcattaatgtttatgggtgttttctgttgttttgtttgtcagtgttattttgtcaatgttgaagtgaattaaggtacatgcaagtgtaataacatatctcctgaagatacttgaatggattaaaaaaacacacaggtatatttgctggatgataaagatttcatgggaaaaaaaatcaattaatctgtctaagctgctttctgatgttggtttcttaataatgagtaaaccacaaattaaatgttattttaacctcaccaaaacaatttataccttgtgtccctaaattgtagccctatattaaattatattacatttcatatgctatatgttatagttcattcatttctcttcaccatgtatcctgcaatactggtacacgaacacactttttacaaaaccacatacccatgtacacatgcctaggtacacatgtacatgcactacagtttaaattatgatgtacttaatgtaacctctaaatattttagaagtatgtacctatagttttacctcaaaaaaatagaaatctctaaagaccagtagaaatattaaaaaatgatgcaaaatcaaaatgagtggctaattctccatacgtaatctgcagatgatcttctctggttgacattttacgtgtggccatcaccccgggttaaataacacctaatctaggtgtttacatgtattcaatatcctagtttgtttcatgtagtttctaattcttaaaggaaagagggtaataattctatttgtgtaatttgtttcctccaaacttaaggccacttatttacacaagatatttgtatgtctactttcctaaagcatttcttcagtgctcagatcagtgtctaattgaagaagattaaaactgctttggtcattaaaaacgtatttaaataggttaattctaagacttgctgctgtgattgacttctagctcactgcctttaaattttaaaaaatttaagaggaaaattttcatgtctccaaagttttataaatacccttcatcaagtcatgcattaaagtatatattagagaaaaaaaaatacttttctcaacctggaagattttagcctaataaagtttttttgaagtaaaagaaaacttgtaaagggaaagaaactagtttgtctaaactctgtattcattttttttttttttgaagtacagtggaatctgttgaatcagatattttatcaagatatctttattttttcttatttcatttttacaaagatcactcccaatgccatatgtaatagacatttaaatttcgtgttctgtataacagccaaattatcatatttatcattgtatttgtcatgcttagctaaagatcatgtatttgttgagaaatagaataacaaaaagtaataggataggctttgaatttttgcagaaatcttcctgtacaaaacacctttaaaaataattttttgaatggtgtgaatccagtagtcccatttctctgacttagttttcttgagtgatttttatcaaggccaagtccccaaacaattccctaccagctctttagagtactgttcaatctggactaaaatggttttaagtttatggagagcttagtccacagaatatagggcggcgagtccagaaatgcttatacaatttttttttcataataagatatgtgctggcatcaagaaacttaaagtggaagcaaaaagacatccaactagttgctggtctctatcatcttatctgatggtatttctattttccttatataatacaccattttagtaagaactcctagaaatttcaagagcatattgccaaaatataaagtatatttcatagtttcttctggctgaaccagtgaaattttattattgcatattaatgatatttgtaaaacttttataaaaattgtcataattttaaatactcacattttaaaaatacttctttaatgactcttcctctaaatttcctggaaatacagataaagattagctagatacaagatacagctaagtatttagacattttgaggctagtatttttcattttattaaaggctaaaaacaataccaccaataaatcatcaaacaaaccgtacaaagtaattctctctttgggaggctcctttcgtgatagagggacatgggtggaattgacaatgaaagttagatgaacaaggtccgtgttattttaggtagtagaacagggtagagtcatgtcattatttgcgggcggaagacactatttaccaggtgttctttgctgaataaatcattaaacatttttaaaaatccaattatccactttattttgtgtcattgacaaaaggatcttttaagtcagaaggtttcaatgtgatttttggcttggctgtttgaataatggttatgtactgttataattgtagacattttctcacgtctaccaggaattgaagtgtaaaactaaaatatttttcataatgcctctgccgtgcagaaggaatgataatccttttgtatacttctttaattttattgtaaaatgtgtaatgacttttacctatatgctgtgggcaggtcctcagtaaaatctattgagtcaatttctagtattaacaggcttttgcttgctatctaagtgtttcaaattatgggaagtgtgagacactggaaggcaagaaaattaacaataatggcatgtgatagcaaaattgtatttcacttattcctgtgaatatttcttgttggtaccaatggtactgtacaaagtgaatgttatagccacaacattctcttgaaaagaacactgtcaagaagtgggaaattgctgtcaggcatttcattgttgtttttaaacttttttaaaagaaatactggttttgcaatatagagatcatgtggtaaagaattttaataagatcttatactaaaaagccttaaatcaatttattgagattcaaaaaatactattataattaattacatcccatacatataggcaaactcatttaaaaaataaaactaattttggtaaaagtacatggcctttgtttttaaaatacataattttaaaataaatcacttgtcatgataaagtccaaaaagaagttatcattcaacattcaactaaggttggagctaagaatttactaatacaaaaaaagttaaaattttttggaccatatatatcttgacagtgtaacttttaagtaggttcatttccatttgcacagaaagtttctgtctttaggaaactgaaaatgaaatactgtggatgctatgactgtttgtcttgtatgtaaataggaaaataataagctgcctattgagtggtatagctgtatgcttacccaaaaaagggaacactgtggttatgacttgtattataaactttctgtagttaataaagttgttatttttataaccatgattatattattattattaataaaatattttatcaaaatgctta

SEQ ID NO: 307 - protein, 88 aa, Homo sapiens
MESSRVRLLPLLGAALLLMLPLLGTRAQEDAELQPRALDIYSAVDDASHEKELCDAGEQCAVRKGARIGKLCDCPRGTSCNSFLLKCL

SEQ ID NO: 308 - DNA, 267 bp, Homo sapiens
atggagagctcccgcgtgaggctgctgcccctcctgggcgccgccctgctgctgatgctacctctgttgggtacccgtgcccaggaggacgccgagctccagccccgagccctggacatctactctgccgtggatgatgcctcccacgagaaggagctgtgtgacgccggtgagcagtgtgcagtgaggaaaggggcaaggatcgggaagctgtgtgactgtccccgaggaacctcctgcaattccttcctcctgaagtgcttatga

SEQ ID NO: 309 - protein, 168 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRHMFGTMTFMLKLNQIYQVTESHGRGKKI

SEQ ID NO: 310 - DNA, 2788 bp, Homo sapiens
  misc_feature (561)..(1068): CDS
tttcactggcaagagacggagtcctgggtttcagttccagttgcctgcggtgggctgtgtgagtttgccaaagtcccctgccctctctgggtctcggttccctcgcctgtccacgtgaggttggaggagctgaacgccgacgtcatttttagctaagagggagcagggtccccgagtcgccggcccagggtctgcgcatccgaggccgcgcgccctttcccctcccccacggctcctccgggccccgcactctgcgccccggctgccgcccagcgccctacaccgccctcagggggccctcgcgggctccccccggccgggatgccagtgccccgcgccacgcgcgcctgctcccgcgccgcctgccctgcagcctgcccgcggcgcctttatacccagcgggctcggcgctcactaatgtttaactcggggccgaaacttgccagcggcgagtgactccaccgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttag

SEQ ID NO: 311 - protein, 247 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEGRSCESNCKVLCCKYRLSQLSHQCNFHTNHCSCFYVDRGSLLV

SEQ ID NO: 312 - DNA, 2700 bp, Homo sapiens
  misc_feature (561)..(1304): CDS
tttcactggcaagagacggagtcctgggtttcagttccagttgcctgcggtgggctgtgtgagtttgccaaagtcccctgccctctctgggtctcggttccctcgcctgtccacgtgaggttggaggagctgaacgccgacgtcatttttagctaagagggagcagggtccccgagtcgccggcccagggtctgcgcatccgaggccgcgcgccctttcccctcccccacggctcctccgggccccgcactctgcgccccggctgccgcccagcgccctacaccgccctcagggggccctcgcgggctccccccggccgggatgccagtgccccgcgccacgcgcgcctgctcccgcgccgcctgccctgcagcctgcccgcggcgcctttatacccagcgggctcggcgctcactaatgtttaactcggggccgaaacttgccagcggcgagtgactccaccgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttag

SEQ ID NO: 313 - protein, 537 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETSMQAHVVKKQTLSSD

SEQ ID NO: 314 - DNA, 2791 bp, Homo sapiens
  misc_feature (561)..(2174): CDS
tttcactggcaagagacggagtcctgggtttcagttccagttgcctgcggtgggctgtgtgagtttgccaaagtcccctgccctctctgggtctcggttccctcgcctgtccacgtgaggttggaggagctgaacgccgacgtcatttttagctaagagggagcagggtccccgagtcgccggcccagggtctgcgcatccgaggccgcgcgccctttcccctcccccacggctcctccgggccccgcactctgcgccccggctgccgcccagcgccctacaccgccctcagggggccctcgcgggctccccccggccgggatgccagtgccccgcgccacgcgcgcctgctcccgcgccgcctgccctgcagcctgcccgcggcgcctttatacccagcgggctcggcgctcactaatgtttaactcggggccgaaacttgccagcggcgagtgactccaccgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaagtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttag

SEQ ID NO: 315 - protein, 616 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAASHMEGT

SEQ ID NO: 316 - DNA, 3849 bp, Homo sapiens
tttcactggcaagagacggagtcctgggtttcagttccagttgcctgcggtgggctgtgtgagtttgccaaagtcccctgccctctctgggtctcggttccctcgcctgtccacgtgaggttggaggagctgaacgccgacgtcatttttagctaagagggagcagggtccccgagtcgccggcccagggtctgcgcatccgaggccgcgcgccctttcccctcccccacggctcctccgggccccgcactctgcgccccggctgccgcccagcgccctacaccgccctcagggggccctcgcgggctccccccggccgggatgccagtgccccgcgccacgcgcgcctgctcccgcgccgcctgccctgcagcctgcccgcggcgcctttatacccagcgggctcggcgctcactaatgtttaactcggggccgaaacttgccagcggcgagtgactccaccgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaagtaat

SEQ ID NO: 317 - protein, 655 aa, Homo sapiens
  misc_feature (561)..(2411): CDS
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWTQCTQNVTWVSQLQKTTLTITEIQQS

SEQ ID NO: 318 - DNA, 2761 bp, Homo sapiens
  misc_feature (561)..(2528): CDS
tttcactggcaagagacggagtcctgggtttcagttccagttgcctgcggtgggctgtgtgagtttgccaaagtcccctgccctctctgggtctcggttccctcgcctgtccacgtgaggttggaggagctgaacgccgacgtcatttttagctaagagggagcagggtccccgagtcgccggcccagggtctgcgcatccgaggccgcgcgccctttcccctcccccacggctcctccgggccccgcactctgcgccccggctgccgcccagcgccctacaccgccctcagggggccctcgcgggctccccccggccgggatgccagtgccccgcgccacgcgcgcctgctcccgcgccgcctgccctgcagcctgcccgcggcgcctttatacccagcgggctcggcgctcactaatgtttaactcggggccgaaacttgccagcggcgagtgactccaccgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttag

SEQ ID NO: 319 - protein, 717 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRITFTFSSQLRSPKPWSMLEWISRQCGILMKTME

SEQ ID NO: 320 - DNA, 3831 bp, Homo sapiens
  misc_feature (561)..(2714): CDS
tttcactggcaagagacggagtcctgggtttcagttccagttgcctgcggtgggctgtgtgagtttgccaaagtcccctgccctctctgggtctcggttccctcgcctgtccacgtgaggttggaggagctgaacgccgacgtcatttttagctaagagggagcagggtccccgagtcgccggcccagggtctgcgcatccgaggccgcgcgccctttcccctcccccacggctcctccgggccccgcactctgcgccccggctgccgcccagcgccctacaccgccctcagggggccctcgcgggctccccccggccgggatgccagtgccccgcgccacgcgcgcctgctcccgcgccgcctgccctgcagcctgcccgcggcgcctttatacccagcgggctcggcgctcactaatgtttaactcggggccgaaacttgccagcggcgagtgactccaccgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaagtaat

SEQ ID NO: 321 - protein, 711 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADVVY

SEQ ID NO: 322 - DNA, 3830 bp, Homo sapiens
  misc_feature (561)..(2696): CDS
tttcactggcaagagacggagtcctgggtttcagttccagttgcctgcggtgggctgtgtgagtttgccaaagtcccctgccctctctgggtctcggttccctcgcctgtccacgtgaggttggaggagctgaacgccgacgtcatttttagctaagagggagcagggtccccgagtcgccggcccagggtctgcgcatccgaggccgcgcgccctttcccctcccccacggctcctccgggccccgcactctgcgccccggctgccgcccagcgccctacaccgccctcagggggccctcgcgggctccccccggccgggatgccagtgccccgcgccacgcgcgcctgctcccgcgccgcctgccctgcagcctgcccgcggcgcctttatacccagcgggctcggcgctcactaatgtttaactcggggccgaaacttgccagcggcgagtgactccaccgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaagtaat

SEQ ID NO: 323 - protein, 717 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRWYTDEDHGIASSTAHQHIYTHMSHFIKQCFSLP

SEQ ID NO: 324 - DNA, 3757 bp, Homo sapiens
  misc_feature (561)..(2714): CDS
tttcactggcaagagacggagtcctgggtttcagttccagttgcctgcggtgggctgtgtgagtttgccaaagtcccctgccctctctgggtctcggttccctcgcctgtccacgtgaggttggaggagctgaacgccgacgtcatttttagctaagagggagcagggtccccgagtcgccggcccagggtctgcgcatccgaggccgcgcgccctttcccctcccccacggctcctccgggccccgcactctgcgccccggctgccgcccagcgccctacaccgccctcagggggccctcgcgggctccccccggccgggatgccagtgccccgcgccacgcgcgcctgctcccgcgccgcctgccctgcagcctgcccgcggcgcctttatacccagcgggctcggcgctcactaatgtttaactcggggccgaaacttgccagcggcgagtgactccaccgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagatggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaagtaat

SEQ ID NO: 325 - DNA, 1737 bp, Homo sapiens
cttctctgccagaagataccatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaagtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacatta

SEQ ID NO: 326 - protein, 240 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 327 - protein, 1063 aa, Homo sapiens
MSPGASRGPRGSQAPLIAPLCCAAAALGMLLWSPACQAFNLDVEKLTVYSGPKGSYFGYAVDFHIPDARTASVLVGAPKANTSQPDIVEGGAVYYCPWPAEGSAQCRQIPFDTTNNRKIRVNGTKEPIEFKSNQWFGATVKAHKGKVVACAPLYHWRTLKPTPEKDPVGTCYVAIQNFSAYAEFSPCRNSNADPEGQGYCQAGFSLDFYKNGDLIVGGPGSFYWQGQVITASVADIIANYSFKDILRKLAGEKQTEVAPASYDDSYLGYSVAAGEFTGDSQQELVAGIPRGAQNFGYVSIINSTDMTFIQNFTGEQMASYFGYTVVVSDVNSDGLDDVLVGAPLFMEREFESNPREVGQIYLYLQVSSLLFRDPQILTGTETFGRFGSAMAHLGDLNQDGYNDIAIGVPFAGKDQRGKVLIYNGNKDGLNTKPSQVLQGVWASHAVPSGFGFTLRGDSDIDKNDYPDLIVGAFGTGKVAVYRARPVVTVDAQLLLHPMIINLENKTCQVPDSMTSAACFSLRVCASVTGQSIANTIVLMAEVQLDSLKQKGAIKRTLFLDNHQAHRVFPLVIKRQKSHQCQDFIVYLRDETEFRDKLSPINISLNYSLDESTFKEGLEVKPILNYYRENIVSEQAHILVDCGEDNLCVPDLKLSARPDKHQVIIGDENHLMLIINARNEGEGAYEAELFVMIPEEADYVGIERNNKGFRPLSCEYKMENVTRMVVCDLGNPMVSGTNYSLGLRFAVPRLEKTNMSINFDLQIRSSNKDNPDSNFVSLQINITAVAQVEIRGVSHPPQIVLPIHNWEPEEEPHKEEEVGPLVEHIYELHNIGPSTISDTILEVGWPFSARDEFLLYIFHIQTLGPLQCQPNPNINPQDIKPAASPEDTPELSAFLRNSTIPHLVRKRDVHVVEFHRQSPAKILNCTNIECLQISCAVGRLEGGESAVLKVRSRLWAHTFLQRKNDPYALASLVSFEVKKMPYTDQPAKLPEGSIAIKTSVIWATPNVSFSIPLWVIILAILLGLLVLAILTLALWKCGFFDRARPPQEDMTDREQLTNDKTPEA

SEQ ID NO: 328 - protein, 270 aa, Homo sapiens [sequence omitted]

SEQ ID NO: 329 - protein, 15 aa, Homo sapiens
  misc_feature: HUMPRE_P4 unique region
EAHGVHSSLRLHRLD

SEQ ID NO: 330 - protein, 217 aa, Homo sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 331 - protein, 104 aa, Homo sapiens
  misc_feature: HUMCS2_P3  unique region
VRVAPGVTNPGTPLASRAGGEKYCCPLFSSKALTQENSPYSSFRLVNPPGLSLHPEGEGGKWINERGREQCPSAWPLLLFLHFAEAGRRQPPDWADPQADLQQV

SEQ ID NO: 332 - DNA, 3608 bp, Homo sapiens
  misc_feature (108)..(290): CDS
gctttcagtcgagggctagcgagcgcagcggagcctggagagaaggcgctgggctgcgagggcgcgagggcgcgagggcagggggcaaccggaccccgcccttacccatggcgcccgtcgccgtctgggccgcgctggccgtcggactggagctctgggctgcggcgcacgccttgcccgcccaggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgggttgtggaaagcctctgctgccatggtgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttacacgtcgacccctgg

SEQ ID NO: 333 - DNA, 3791 bp, Homo sapiens
  misc_feature (108)..(575): CDS
gctttcagtcgagggctagcgagcgcagcggagcctggagagaaggcgctgggctgcgagggcgcgagggcgcgagggcagggggcaaccggaccccgcccttacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccagacctctcctagggctctagtgccaaggcccagctgtcccgcagagtgtctgagtggttgacaagttcggattgttccctgaaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgggttgtggaaagcctctgctgccatggtgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttacacgtcgacccctgg

SEQ ID NO: 334 - protein, 17 aa, Homo sapiens
KTGFHRVSQDGLDLLTS

SEQ ID NO: 335 - protein, 149 aa, Homo sapiens; identical to SEQ ID NO: 124

SEQ ID NO: 336 - DNA, 1328 bp, Homo sapiens; identical to SEQ ID NO: 127

SEQ ID NO: 337 - protein, 55 aa, Homo sapiens
  misc_feature: HSICAM_P8 unique region
LGCTISEPCPCRHLVTGNHHVCKTTTQSSLHPQLLPSSSLHWSRPGHLLPNRGTP

SEQ ID NO: 338 - protein, 149 aa, Homo sapiens; identical to SEQ ID NO: 124

SEQ ID NO: 339 - DNA, 1443 bp, Homo sapiens; identical to SEQ ID NO: 125

SEQ ID NO: 340 - protein, 40 aa, Homo sapiens
  misc_feature: HSICAM_P12 unique region
REWLCCGALLSPGTEAVSTECTQSPSVPAPGHCHRGALPP

SEQ ID NO: 341 - DNA, 3817 bp, Homo sapiens
  misc_feature (274)..(1113): CDS
taatttaatacagagagacaaatatctggtgcaaaagtattccgaacaatttatatagatactctcaccttaaggatagggaccataattctccattcttttaaagtgctggctatatgtagtgactttcttccaaagtacagtacgggtggctggcaagatggccgaataggaagagctccagtctacagctcccgcagagatcaacgcagaaggaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgcttttttttttttttttcgaaaaagttcacccaatccctaggctttttacttttttctttttcttttcttttttcttgtttttttttttttttcattttgttttgttttgttatgtttttttagacagggtcccactctgtcacccaggctggagtgcagtggtgcaatcacaggacactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacagctgatgccagctacagaatcactatgtttcaatatggaatatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatga

SEQ ID NO: 342 - DNA, 1252 bp, Homo sapiens
  misc_feature (330)..(1007): CDS
cagagttgcagtgacctaaacaggaagttgggctattcccaactgccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttggtaagaatcttgtggattttattgcttccaggaaactattatcatgctaacaatgaagtggattgtgtattagaagtatgtctttaaatatatatatatacctgcgttgttgcttaataatgtgtttgttgaaatactgagattcaaattgtttaagacatttaatctcataaaagcaacaattttcctaatctattttaaagtatgctttgaagtaagcttttgattatgtatcacatgaaaaactttcatatgatatttaactctatgccaaatttattttgtaaaatggtgc

SEQ ID NO: 343 - DNA, 1309 bp, Homo sapiens
  misc_feature (615)..(1007): CDS
cagagttgcagtgacctaaacaggaagttgggctattcccaactgccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttatgacaaatgagctccacatgcttaaaatcaatcaagtgatcacttgttcaacaggacaggaaaggccatgtgaggacatagggagaaagcagccaccattggcaagccaagagagagccctcaccaggaacgattggaccagcaccttgatcttggattttctagcctccagaacttacagtacgggtggctggcaagatggccgaataggaagagctccagtctacagctcccgcagagatcaacgcagaaggaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagaggtaggtttctgggaacccttattactcaagaccctttagggctattgagtctaattatggatttgataatttagggagaaaagtaatttcatgctgttttaatatttccaaggaatcttttatttccacatttttagactttcagggaatcctaaaaacatttaaggaaaatgataattctgaattgtaccatgaaatacccacatttataggtaccagaaactctctatatgcccgagagacattttaaagcaaattatcaaattttaggtacggtcaacttgcatgttcaactatcatttttcattttcttcatatcagtgaattataaaatatgaggccccatttattgtcttatactcttatccataataaa

SEQ ID NO: 344 - DNA, 177 bp, Homo sapiens
cagagttgcagtgacctaaacaggaagttgggctattcccaactgccagtgatctctgaagccgactctgaggctccctctttgctctaacagacagcagcgactttaggctggataatagtcaaattcttacctcgctctttcactgctagtaagatcagattgcgtttctttcag

SEQ ID NO: 345 - DNA, 150 bp, Homo sapiens
ttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttactt

SEQ ID NO: 346 - DNA, 122 bp, Homo sapiens
gacaggaaaggccatgtgaggacatagggagaaagcagccaccattggcaagccaagagagagccctcaccaggaacgattggaccagcaccttgatcttggattttctagcctccagaact

SEQ ID NO: 347 - DNA, 138 bp, Homo sapiens
taatttaatacagagagacaaatatctggtgcaaaagtattccgaacaatttatatagatactctcaccttaaggatagggaccataattctccattcttttaaagtgctggctatatgtagtgactttcttccaaag

SEQ ID NO: 348 - DNA, 123 bp, Homo sapiens
agatgatttacacaatgaagaaagtacatgcactttgggcttctgtatgcctgctgcttaatcttgcccctgcccctcttaatgctgattctgaggaagatgaagaacacacaattatcacag

SEQ ID NO: 349 - DNA, 148 bp, Homo sapiens
gcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagag

SEQ ID NO: 350 - DNA, 376 bp, Homo sapiens
gtaggtttctgggaacccttattactcaagaccctttagggctattgagtctaattatggatttgataatttagggagaaaagtaatttcatgctgttttaatatttccaaggaatcttttatttccacatttttagactttcagggaatcctaaaaacatttaaggaaaatgataattctgaattgtaccatgaaatacccacatttataggtaccagaaactctctatatgcccgagagacattttaaagcaaattatcaaattttaggtacggtcaacttgcatgttcaactatcatttttcattttcttcatatcagtgaattataaaatatgaggccccatttattgtcttatactcttatccataataaa

SEQ ID NO: 351 - DNA, 177 bp, Homo sapiens
aaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtc

SEQ ID NO: 352 - DNA, 295 bp, Homo sapiens
gtaagaatcttgtggattttattgcttccaggaaactattatcatgctaacaatgaagtggattgtgtattagaagtatgtctttaaatatatatatatacctgcgttgttgcttaataatgtgtttgttgaaatactgagattcaaattgtttaagacatttaatctcataaaagcaacaattttcctaatctattttaaagtatgctttgaagtaagcttttgattatgtatcacatgaaaaactttcatatgatatttaactctatgccaaatttattttgtaaaatggtgc

SEQ ID NO: 353 - DNA, 180 bp, Homo sapiens
aatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaag

SEQ ID NO: 354 - DNA, 1306 bp, Homo sapiens
gtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactag

SEQ ID NO: 355 - DNA, 248 bp, Homo sapiens
ctaaacagtctccaaatctttatgcttttttttttttttttcgaaaaagttcacccaatccctaggctttttacttttttctttttcttttcttttttcttgtttttttttttttttcattttgttttgttttgttatgtttttttagacagggtcccactctgtcacccaggctggagtgcagtggtgcaatcacaggacactgaaacctcccacctagctgggactagaggtgcaggccaccacac

SEQ ID NO: 356 - DNA, 1167 bp, Homo sapiens
cagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacagctgatgccagctacagaatcactatgtttcaatatggaatatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatgaaacctggctgttgtactcgtaaagattttagtacata

SEQ ID NO: 357 - DNA, 55 bp, Homo sapiens
atgacaaatgagctccacatgcttaaaatcaatcaagtgatcacttgttcaacag

SEQ ID NO: 358 - DNA, 5 bp, Homo sapiens
tacag

SEQ ID NO: 359 - DNA, 72 bp, Homo sapiens
tacgggtggctggcaagatggccgaataggaagagctccagtctacagctcccgcagagatcaacgcagaag

SEQ ID NO: 360 - DNA, 31 bp, Homo sapiens
gaacagcagtctcagcggttagcagcacaag

SEQ ID NO: 361 - DNA, 50 bp, Homo sapiens
atacggagttgccaccactgaaacttatgcattcattttgtgcattcaag

SEQ ID NO: 362 - DNA, 39 bp, Homo sapiens
ataatgcaaacaggattataaagacaacattgcaacaag

SEQ ID NO: 363 - DNA, 93 bp, Homo sapiens
cgaatggtttccaggtggataattatggaacccagctcaatgctgtgaataactccctgactccgcaatcaaccaaggttcccagcctttttg

SEQ ID NO: 364 - DNA, 12 bp, Homo sapiens
cttcatgaatag

SEQ ID NO: 365 - DNA, 115 bp, Homo sapiens
cttcatgaatagcttcatgacttctcgctaacaatgatagtataattctgcctgttcttcaggattgaaattttgaactcaatttagatttcctgttttccctcatataccacat

SEQ ID NO: 366 - protein, 304 aa, Homo sapiens
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFEFHGPSWCLTPADRGLCRANENRFYYNSVIGKCRPFKYSGCGGNENNFTSKQECLRACKKGFIQRISKGGLIKTKRKRKKQRVKIAYEEIFVKNM

SEQ ID NO: 367 - protein, 279 aa, Homo sapiens
MHFGLLYACCLILPLPLLMLILRKMKNTQLSQADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFEFHGPSWCLTPADRGLCRANENRFYYNSVIGKCRPFKYSGCGGNENNFTSKQECLRACKKGFIQRISKGGLIKTKRKRKKQRVKIAYEEIFVKNM

SEQ ID NO: 368 - protein, 225 aa, Homo sapiens
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFGKNLVDFIASRKLLSC

SEQ ID NO: 369 - protein, 130 aa, Homo sapiens
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRGRFLGTLITQDPLGLLSLIMDLII

SEQ ID NO: 370 - DNA, 3703 bp, Homo sapiens
  misc_feature (108)..(566): CDS
gctttcagtcgagggctagcgagcgcagcggagcctggagagaaggcgctgggctgcgagggcgcgagggcgcgagggcagggggcaaccggaccccgcccttacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgggttgtggaaagcctctgctgccatggtgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttacacgtcgacccctgg

SEQ ID NO: 371 - DNA, 10829 bp, Homo sapiens
  misc_feature (504)..(1556): CDS
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaatgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaaggtaggaagcccgccggtgtgcggacgaggcttgttctcggctgctgaggctgggctctcatgccacctccaaaggaacacatcttcctcttctcattaaaaaacaactatacatatcgtttctttaaaacagaagataaagctgtaaagccaggttaggcaatgggaaggcactgaaggttgtgacggggtggggggctctgatgagaacagtcacagagccagccccgctcagcagctgccaggtgcccagccctggggagaatccagggaaggcagagctggaagcagtgcagctccaagcggcccatgggaaataatgaggagaacgcaaggtcagtgtgaggtgacagggatggcatctcctacaccgccgtagccccaaagtgtactataggtcctggtgtccccccttcccgcctgcactctccccagccccttcagtgtttgttgagtgaatgaaggatgatgtggcagtggcggttccggtgaccggaattccttcctgcttccctctgcctgtggatccctagctattcttaatccaacaaatgtgaacggaatacacgtctctcttatctctgcagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttcttcatattttaattttccaccataaagtttagttgctaaattctattaattttaagattgtgcttcccaaaatagttctcacttcatctgtccagggaggcacagttctgtctggtagaagccgcaaagcccttagcctcttcacggatctggcgactgtgatgggcaggtcaggagaggagctgcccaaagtcccatgattttcacctaacagccctgatcggtcagtactcaaagcttggactccatccctgaaggtcttcctgattgatagcctggccttaataccctacagaaagcctgtccattggctgtttcttcctcagtcagttcctggaagaccttaccccatgaccccagcttcagatgtggtctttggaaacagaggtcgaaggaaagtaaggagctgagagctcacattcataggtgccgccagccttcgtgcatcttcttgcatcatctctaaggagctcctctaattacaccatgcccgtcaccccatgagggatcagagaagggatgagtcttctaaactctatattcgctgtgagtccaggttgtaagggggagcactgtggatgcatcctattgcactccagctgatgacaccaaagcttaggtgtttgctgaaagttcttgatgttgtgacttaccacccctgcctcacaactgcagacataaggggactatggattgcttagcaggaaaggcactggttctcaagggcggctgcccttgggaatcttctggtcccaaccagaaagactgtggcttgattttctcaggtgcagcccagccgtagggccttttcagagcaccccctggttattgcaacattcatcaaagtttctagaacctctggcctaaaggaagggcctggtgggatctacttggcactcgctggggggccaccccccagtgccactctcactaggcctctgattgcacttgtgtaggatgaagctggtgggtgatgggaactcagcacctcccctcaggcagaaaagaatcatctgtggagcttcaaaagaaggggcctggagtctctgcagaccaattcaacccaaatctcgggggctctttcatgattctaatgggcaaccagggttgaaacccttatttctagggtcttcagttgtacaagactgtgggtctgtaccagagcccccgtcagagtagaataaaaggctgggtagggtagagattcccatgtgcagtggagagaacaatctgcagtcactgataagcctgagacttggctcatttcaaaagcgttcaattcatcctcaccagcagttcagctggaaaggggcaaatacccccacctgagctttgaaaacgccctgggaccctctgcattctctaagtaagttatagaaaccagtctcttccctcctttgtgagtgagctgctattccacgtaggcaacacctgttgaaattgccctcaatgtctactctgcatttctttcttgtgataagcacacacttttattgcaacataatgatctgctcacatttccttgcctgggggctgtaaaaccttacagaacagaaatccttgcctctttcaccagccacacctgccataccaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaagagaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctagagaagttattcagccctggctgcagtgacatcacctgaggagcttttaaaagcttgaagcccagctacacctcagaccgattaaacgcaaatctctggggctgaaacccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcatgagtaccttataataataataatgtattctttgttaacaatgccatgttggtactagttattaatcatatctaaccaactgtaggtgttctttcctgataacttttttaaaaaatcaataaattatttttagagca

SEQ ID NO: 372 - DNA, 3856 bp, Homo sapiens
  misc_feature (504)..(2621): CDS
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaatgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggccaggaaatgagagtctcaaagccatgttattctgcctttttaaactatcatcctgtaatcaaagtaatgatggcagcgtgtcccaccagagcgggagcccagctgctcaggagtcatgcttaggatggatcccttctcttctgccgtcagagtttcagctgggttggggtggatgcagccacctccatgcctggccttctgcatctgtgatcatcacggcctcctcctgccactgagcctcatgccttcacgtgtctgttccccccgcttttcctttctgccacccctgcacgtgggccgccaggttcccaagagtatcctacccatttccttccttccactccctttgccagtgcctctcaccccaactagtagctaaccatcacccccaggactgacctcttcctcctcgctgccagatgattgttcaaagcacagaatttgtcagaaacctgcagggactccatgctgccagccttctccgtaattagcatggccccagtccatgcttctagccttggttccttctgcccctctgtttgaaattctagagccagctgtgggacaattatctgtgtcaaaagccagatgtgaaaacatctcaataacaaactggctgctttgttcaatgctagaacaacgcctgtcacagagtagaaactcaaaaatatttgctgagtgaatgaacaaatgaataaatgcataataaataattaaccaccaatccaacatccagacacatagtgattttaattatttaagagtagtttagcatatattgctttatgatttaattaaaaatctccaaaatatatgccaaagaagtagaatgagaaaaatgtatatttctctttcacttcctacagatgcactgggccaggtcttgaaggctgtccaacgaatgggtaagtgttcacagctctgtgtcacatggacctcgtcaagaatgaccacactgctgtgggtgaagatgctttcctgcatttctgactgtcctctgtcctgatcaagtttctatggctctgggccagcctaccctcagccagggtttctgcagagactgcccagctggttccacgtggctccacgtgccaactttgtcctcagtggagggaaagttggacacacagtgctggggctgctccctgctccgccgttgctcgatgcatggcctgcctctgaattccttggttccactggttttgctgggtccttctgtgcctctagctcctctttttttctgtccacttaccccattggtcccatcacaagcctgtgtgtgagtggcctttctgttcgatgacaacctccagcataggggagtgtttctccttgctttctttcccagacacactgcccagcaaaggcaaaagggcttccttcaacatcagctctggccagtttgccagagcaaagccctgagaaaagcaaggttgaaaagtcttattcaaactcaccaggaaagagtggt

SEQ ID NO: 373 - DNA, 1894 bp, Homo sapiens
  misc_feature (504)..(1457): CDS
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaatgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtgagtcctcctctgtgggccctctaactggtcaggcatccttgtcccgctctgtctcctgctgagccctggagtatcccatcttggagagtctttgggtggatgtgtttgccttgcttggaggaggcgaccctgtgcccgtccaggcacacaggcgaggggaggggctggcttgctaccgaggagcgggcaggtggtggccatctccacccatgggggctgctcagtgcacagggcagatctgggtggccaggccacctcacaggagaaacacctgctgctcagccctcaccactcatccagcagccacagccgtgggtattcagttgtctgctgggcacaaagccgtgggcatgccactgtttagtgcttgtgccaagcaggtatttaatacaccgaaatcagagagtctatcagaagacctgccttcttgagtggttaaaattctagtgaaagttatgcctcttaggagtattgcagaggttttgtttttgtttttatt

SEQ ID NO: 374 - DNA, 1832 bp, Homo sapiens
  misc_feature (504)..(1151): CDS
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaatgtggagagcatccagtggcgggacatagtcagcagtgactttctcagcaacatgtcgatggacttccagaaccacctgggcagctgtaagtgtcgcatacacactatctctgcctccagctcctatgggggacagctctacagcactggggcaggggagagaagccatgtttagtaagtcacattaatcagaaacaaaaagtagtaagcaaaatatctgaccactagaaaagcatgtatttaccacggacatagagatcgtttttttgtggcgggtggcagcccagctggttggcagttcaggccaccggaggcagatcccctgcagggacagcagagcacttgtgtcctgagaagagctgctgttcatggggctggcagcaccagggcctctcctagcctgccctgctgacactggccagactcctacatgcttctgagtctccagaggctacccggccctcctgaagcaccagggctgaatccacccccagctgagggcatgaacactgccacatggagtcacacacacagctgggcactgccatggagaggaagtctgtccatgtttccttgaatactggtggcctggtccctgtcccattccccagtgaggcagcctgtggggaagcctggcagggaaccaggcgcaggtcagcgtggcgccctgactcaggccagcactgatgggggactctgagacgcaagctcacactcacccagctcccctgggctgcgcccgttcctgatcgcttggactttctgttctttagagtaagaagtgatcaccatttcctgcttctttgtttctccacaactgtgcagtggatgcctgtttgttttctgccctcagaac

SEQ ID NO: 375 - DNA, 486 bp, Homo sapiens
tggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaag

SEQ ID NO: 376 - DNA, 152 bp, Homo sapiens
tttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaag

SEQ ID NO: 377 - DNA, 184 bp, Homo sapiens
accatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagg

SEQ ID NO: 378 - DNA, 135 bp, Homo sapiens
aaatcctgcatggcgccgtgcggttcagcaacaaccctgccctgtgcaatgtggagagcatccagtggcgggacatagtcagcagtgactttctcagcaacatgtcgatggacttccagaaccacctgggcagct

SEQ ID NO: 379 - DNA, 770 bp, Homo sapiens
gtaagtgtcgcatacacactatctctgcctccagctcctatgggggacagctctacagcactggggcaggggagagaagccatgtttagtaagtcacattaatcagaaacaaaaagtagtaagcaaaatatctgaccactagaaaagcatgtatttaccacggacatagagatcgtttttttgtggcgggtggcagcccagctggttggcagttcaggccaccggaggcagatcccctgcagggacagcagagcacttgtgtcctgagaagagctgctgttcatggggctggcagcaccagggcctctcctagcctgccctgctgacactggccagactcctacatgcttctgagtctccagaggctacccggccctcctgaagcaccagggctgaatccacccccagctgagggcatgaacactgccacatggagtcacacacacagctgggcactgccatggagaggaagtctgtccatgtttccttgaatactggtggcctggtccctgtcccattccccagtgaggcagcctgtggggaagcctggcagggaaccaggcgcaggtcagcgtggcgccctgactcaggccagcactgatgggggactctgagacgcaagctcacactcacccagctcccctgggctgcgcccgttcctgatcgcttggactttctgttctttagagtaagaagtgatcaccatttcctgcttctttgtttctccacaactgtgcagtggatgcctgtttgttttctgccctcagaac

SEQ ID NO: 380 - DNA, 142 bp, Homo sapiens
gtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtcccc

SEQ ID NO: 381 - DNA, 502 bp, Homo sapiens
gtgagtcctcctctgtgggccctctaactggtcaggcatccttgtcccgctctgtctcctgctgagccctggagtatcccatcttggagagtctttgggtggatgtgtttgccttgcttggaggaggcgaccctgtgcccgtccaggcacacaggcgaggggaggggctggcttgctaccgaggagcgggcaggtggtggccatctccacccatgggggctgctcagtgcacagggcagatctgggtggccaggccacctcacaggagaaacacctgctgctcagccctcaccactcatccagcagccacagccgtgggtattcagttgtctgctgggcacaaagccgtgggcatgccactgtttagtgcttgtgccaagcaggtatttaatacaccgaaatcagagagtctatcagaagacctgccttcttgagtggttaaaattctagtgaaagttatgcctcttaggagtattgcagaggttttgtttttgtttttatt

SEQ ID NO: 382 - DNA, 586 bp, Homo sapiens
gtaggaagcccgccggtgtgcggacgaggcttgttctcggctgctgaggctgggctctcatgccacctccaaaggaacacatcttcctcttctcattaaaaaacaactatacatatcgtttctttaaaacagaagataaagctgtaaagccaggttaggcaatgggaaggcactgaaggttgtgacggggtggggggctctgatgagaacagtcacagagccagccccgctcagcagctgccaggtgcccagccctggggagaatccagggaaggcagagctggaagcagtgcagctccaagcggcccatgggaaataatgaggagaacgcaaggtcagtgtgaggtgacagggatggcatctcctacaccgccgtagccccaaagtgtactataggtcctggtgtccccccttcccgcctgcactctccccagccccttcagtgtttgttgagtgaatgaaggatgatgtggcagtggcggttccggtgaccggaattccttcctgcttccctctgcctgtggatccctagctattcttaatccaacaaatgtgaacggaatacacgtctctcttatctctgcag

SEQ ID NO: 383 - DNA, 127 bp, Homo sapiens
tgtgtaacggaataggtattggtgaatttaaagactcactctccataaatgctacgaatattaaacacttcaaaaactgcacctccatcagtggcgatctccacatcctgccggtggcatttagggg

SEQ ID NO: 384 - DNA, 200 bp, Homo sapiens
tggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgca

SEQ ID NO: 385 - DNA, 868 bp, Homo sapiens
gccaggaaatgagagtctcaaagccatgttattctgcctttttaaactatcatcctgtaatcaaagtaatgatggcagcgtgtcccaccagagcgggagcccagctgctcaggagtcatgcttaggatggatcccttctcttctgccgtcagagtttcagctgggttggggtggatgcagccacctccatgcctggccttctgcatctgtgatcatcacggcctcctcctgccactgagcctcatgccttcacgtgtctgttccccccgcttttcctttctgccacccctgcacgtgggccgccaggttcccaagagtatcctacccatttccttccttccactccctttgccagtgcctctcaccccaactagtagctaaccatcacccccaggactgacctcttcctcctcgctgccagatgattgttcaaagcacagaatttgtcagaaacctgcagggactccatgctgccagccttctccgtaattagcatggccccagtccatgcttctagccttggttccttctgcccctctgtttgaaattctagagccagctgtgggacaattatctgtgtcaaaagccagatgtgaaaacatctcaataacaaactggctgctttgttcaatgctagaacaacgcctgtcacagagtagaaactcaaaaatatttgctgagtgaatgaacaaatgaataaatgcataataaataattaaccaccaatccaacatccagacacatagtgattttaattatttaagagtagtttagcatatattgctttatgatttaattaaaaatctccaaaatatatgccaaagaagtagaatgagaaaaatgtatatttctctttcacttcctacag

SEQ ID NO: 386 - DNA, 566 bp, Homo sapiens
gtaagtgttcacagctctgtgtcacatggacctcgtcaagaatgaccacactgctgtgggtgaagatgctttcctgcatttctgactgtcctctgtcctgatcaagtttctatggctctgggccagcctaccctcagccagggtttctgcagagactgcccagctggttccacgtggctccacgtgccaactttgtcctcagtggagggaaagttggacacacagtgctggggctgctccctgctccgccgttgctcgatgcatggcctgcctctgaattccttggttccactggttttgctgggtccttctgtgcctctagctcctctttttttctgtccacttaccccattggtcccatcacaagcctgtgtgtgagtggcctttctgttcgatgacaacctccagcataggggagtgtttctccttgctttctttcccagacacactgcccagcaaaggcaaaagggcttccttcaacatcagctctggccagtttgccagagcaaagccctgagaaaagcaaggttgaaaagtcttattcaaactcaccaggaaagagtggt

SEQ ID NO: 387 - DNA, 142 bp, Homo sapiens
gcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggag

SEQ ID NO: 388 - DNA, 123 bp, Homo sapiens
cttgtggagcctcttacacccagtggagaagctcccaaccaagctctcttgaggatcttgaaggaaactgaattcaaaaagatcaaagtgctgggctccggtgcgttcggcacggtgtataag

SEQ ID NO: 389 - DNA, 186 bp, Homo sapiens
gaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaag

SEQ ID NO: 390 - DNA, 156 bp, Homo sapiens
ggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaa

SEQ ID NO: 391 - DNA, 147 bp, Homo sapiens
gggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagt

SEQ ID NO: 392 - DNA, 168 bp, Homo sapiens
ggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctg

SEQ ID NO: 393 - DNA, 1505 bp, Homo sapiens
aatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcag

SEQ ID NO: 394 - DNA, 846 bp, Homo sapiens
ctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcag

SEQ ID NO: 395 - DNA, 1812 bp, Homo sapiens
cggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttcttcatattttaattttccaccataaagtttagttgctaaattctattaattttaagattgtgcttcccaaaatagttctcacttcatctgtccagggaggcacagttctgtctggtagaagccgcaaagcccttagcctcttcacggatctggcgactgtgatgggcaggtcaggagaggagctgcccaaagtcccatgattttcacctaacagccctgatcggtcagtactcaaagcttggactccatccctgaaggtcttcctgattgatagcctggccttaataccctacagaaagcctgtccattggctgtttcttcctcagtcagttcctggaagaccttaccccatgaccccagcttcagatgtggtctttggaaacagaggtcgaaggaaagtaaggagctgagagctcacattcataggtgccgccagccttcgtgcatcttcttgcatcatctctaaggagctcctctaattacaccatgcccgtcaccccatgagggatcagagaagggatgagtcttctaaactctatattcgctgtgagtccaggttgtaagggggagcactgtggatgcatcctattgcactccagctgatgacaccaaagcttaggtgtttgctgaaagttcttgatgttgtgacttaccacccctgcctcacaactgcagacataaggggactatggattgcttagcaggaaaggcactggttctcaagggcggctgcccttgggaatcttctggtcccaaccagaaagactgtggcttgattttctcaggtgcagcccagccgtagggccttttcagagcaccccctggttattgcaacattcatcaaagtttctagaacctctggcctaaaggaagggcctggtgggatctacttggcactcgctggggggccaccccccagtgccactctcactaggcctctgattgcacttgtgtaggatgaagctggtgggtgatgggaactcagcacctcccctcaggcagaaaagaatcatctgtggagcttcaaaagaaggggcctggagtctctgcagaccaattcaacccaaatctcgggggctctttcatgattctaatgggcaaccagggttgaaacccttatttctagggtcttcagttgtacaagactgtgggtctgtaccagagcccccgtcagagtagaataaaaggctgggtagggtagagattcccatgtgcagtggagagaacaatctgcagtcactgataagcctgagacttggctcatttcaaaagcgttcaattcatcctcaccagcagttcagctggaaaggggcaaataccccca

SEQ ID NO: 396 - DNA, 518 bp, Homo sapiens
tctcttccctcctttgtgagtgagctgctattccacgtaggcaacacctgttgaaattgccctcaatgtctactctgcatttctttcttgtgataagcacacacttttattgcaacataatgatctgctcacatttccttgcctgggggctgtaaaaccttacagaacagaaatccttgcctctttcaccagccacacctgccataccaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaag

SEQ ID NO: 397 - DNA, 369 bp, Homo sapiens
agaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctag

SEQ ID NO: 398 - DNA, 319 bp, Homo sapiens
ccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtgga

SEQ ID NO: 399 - DNA, 239 bp, Homo sapiens
ctagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatac

SEQ ID NO: 400 - DNA, 694 bp, Homo sapiens
ctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcatgagtaccttataataataataatgtattctttgttaacaatgccatgttggtactagttattaatcatatctaaccaactgtaggtgttctttcctgataacttttttaaaaaatcaataaattatttttagagca

SEQ ID NO: 401 - DNA, 105 bp, Homo sapiens
gaaaacaggctgggcccggtggctcactcctgtaatcccagcactttgggaggttgaggtgggcggatcacctgaggtcaggagtttgagaccagccggcgggag

SEQ ID NO: 402 - DNA, 69 bp, Homo sapiens
gccaaaagtgtgatccaagctgtcccaatgggagctgctggggtgcaggagaggagaactgccagaaac

SEQ ID NO: 403 - DNA, 119 bp, Homo sapiens
tgaccaaaatcatctgtgcccagcagtgctccgggcgctgccgtggcaagtcccccagtgactgctgccacaaccagtgtgctgcaggctgcacaggcccccgggagagcgactgcctg

SEQ ID NO: 404 - DNA, 117 bp, Homo sapiens
gtaattatgtggtgacagatcacggctcgtgcgtccgagcctgtggggccgacagctatgagatggaggaagacggcgtccgcaagtgtaagaagtgcgaagggccttgccgcaaag

SEQ ID NO: 405 - DNA, 74 bp, Homo sapiens
tgactccttcacacatactcctcctctggatccacaggaactggatattctgaaaaccgtaaaggaaatcacag

SEQ ID NO: 406 - DNA, 91 bp, Homo sapiens
ggtttttgctgattcaggcttggcctgaaaacaggacggacctccatgcctttgagaacctagaaatcatacgcggcaggaccaagcaaca

SEQ ID NO: 407 - DNA, 100 bp, Homo sapiens
aggccacaggccaggtctgccatgccttgtgctcccccgagggctgctggggcccggagcccagggactgcgtctcttgccggaatgtcagccgaggcag

SEQ ID NO: 408 - DNA, 33 bp, Homo sapiens
ggaatgcgtggacaagtgcaaccttctggaggg

SEQ ID NO: 409 - DNA, 91 bp, Homo sapiens
tgagccaagggagtttgtggagaactctgagtgcatacagtgccacccagagtgcctgcctcaggccatgaacatcacctgcacaggacgg

SEQ ID NO: 410 - DNA, 70 bp, Homo sapiens
ggaccagacaactgtatccagtgtgcccactacattgacggcccccactgcgtcaagacctgcccggcag

SEQ ID NO: 411 - DNA, 88 bp, Homo sapiens
gagtcatgggagaaaacaacaccctggtctggaagtacgcagacgccggccatgtgtgccacctgtgccatccaaactgcacctacgg

SEQ ID NO: 412 - DNA, 39 bp, Homo sapiens
atgcactgggccaggtcttgaaggctgtccaacgaatgg

SEQ ID NO: 413 - DNA, 99 bp, Homo sapiens
ggactctggatcccagaaggtgagaaagttaaaattcccgtcgctatcaaggaattaagagaagcaacatctccgaaagccaacaaggaaatcctcgat

SEQ ID NO: 414 - DNA, 76 bp, Homo sapiens
gtgcctatcaagtggatggcattggaatcaattttacacagaatctatacccaccagagtgatgtctggagctacg

SEQ ID NO: 415 - DNA, 98 bp, Homo sapiens
gctggatgatagacgcagatagtcgcccaaagttccgtgagttgatcatcgaattctccaaaatggcccgagacccccagcgctaccttgtcattcag

SEQ ID NO: 416 - DNA, 48 bp, Homo sapiens
agtgcaaccagcaacaattccaccgtggcttgcattgatagaaatggg

SEQ ID NO: 417 - DNA, 109 bp, Homo sapiens
ctgcaaagctgtcccatcaaggaagacagcttcttgcagcgatacagctcagaccccacaggcgccttgactgaggacagcatagacgacaccttcctcccagtgcctg

SEQ ID NO: 418 - DNA, 60 bp, Homo sapiens
cctgagctttgaaaacgccctgggaccctctgcattctctaagtaagttatagaaaccag

SEQ ID NO: 419 - DNA, 4 bp, Homo sapiens
agaa

SEQ ID NO: 420 - DNA, 30 bp, Homo sapiens
gttattcagccctggctgcagtgacatcac

SEQ ID NO: 421 - DNA, 66 bp, Homo sapiens
ctgaggagcttttaaaagcttgaagcccagctacacctcagaccgattaaacgcaaatctctgggg

SEQ ID NO: 422 - DNA, 7 bp, Homo sapiens
ctgaaac

SEQ ID NO: 423 - protein, 705 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGPGNESLKAMLFCLFKLSSCNQSNDGSVSHQSGSPAAQESCLGWIPSLLPSEFQLGWGGCSHLHAWPSASVIITASSCH

SEQ ID NO: 424 - protein, 317 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRESSSVGPLTGQASLSRSVSC

SEQ ID NO: 425 - protein, 215 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCKCRIHTISASSSYGGQLYSTGAGERSHV

SEQ ID NO: 426 - protein, 350 aa, Homo sapiens [sequence omitted]

SEQ ID NO: 427 - protein, 1210 aa, Homo sapiens [sequence omitted]

SEQ ID NO: 428 - DNA, 9836 bp, Homo sapiens
  misc_feature (1041)..(1472): CDS
atcggcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcagaccaaagaaagatagagcaagacaagaaaagtaagtggccctgactttagcacttctccctctccatggccggttgtcttggtttggggctcttggctacctctgttgggggctcccatagcctccctgggtcagggacttggtcttgtgggggacttgtggtggcagcaacaatgggatggagccaactccaggatgatggctctagggctagtgagaaaacatagccaggagcctggcacttcctttggaagggacaatgccttctgggtctccagatcattcctgaccaggacttgctgtttcggtgtgtcagggggcactgtggacactggctcactggcttgctctaggacacccacagtggggagagggagtgggtggcagagaggccagcttttgtgtgtcagaggaaatggcctcttttggtggctgctgtgacggtgcagttggatgcgaggccggctggagggtggtttctcagtgcatgccctcctgtaggcggcaggcggcagacacacagccctcttggccagggagaaaaagttgaatgttggtcattttcagaggcttgtgagtgctccgtgttaaggggcaggtaggatggggtgggggacaaggtctggcggcagtaacccttcaagacagggtgggcggctggcatcagcaagagcttgcagggaaagagagactgagagagagcacctgtgccctgccctttcccccacaccatcttgtctgcctccagtgctgtgcggacattgaagcccccaccaggcctcaaccccttgcctcttccctcagctcccagcttccagagcgaggggatgcggaaaccttccttccaccctttggtgctttctcctaagggggacagacttgccctctctggtcccttctccccctcctttcttccctgtgacagacatcctgaggtgtgttctcttgggcttggcaggcatggagagctctggttctcttgaaggggacaggctacagcctgccccccttcctgtttccccaaatgactgctctgccatggggagagtagggggctcgcctgggctcggaagagtgtctggtgagatggtgtagcaggctttgacaggctggggagagaactccctgccaagtaccgcccaagcctctcctccccagacctccttaactcccaccccatcctgctgcctgcccagggctccaggacacccagccctgcctcccagtccaggtcgtgctgagcaggctggtgttgctcttggttccgtgccagctcccaaggtagccgcttcccccacaccgggattcccagaggttctgtcgcagttgcaaatgaaggcacaaggtgcctgatacacagccctccctcccactcctgctccccatccaggcaggtctctgaccttctccccaaagtctggcctaccttttatcacccccggaccttcagggtcagacttggacagggctgctgggcaaagagccttccctcaggctttgccccctgccggggactgggagccactgtgagtgtggagacctttgggtcctgtgccctccacccagtctcggcttcccaccaaagccttgtcaggggctgggtttgccatcccatggtgggcagcgtgaggagaagaaagagccatcgagtgcttgctgcccagacacgcctgtgtgcgcccgcgcatgcctccccagagaccacctgcctcctgacacttcctccgggaagcggccctgtgtggctttgctttggtcgttcccccatccctgcccaccttaccacttcttttactccccccaccgcccccgctctctctctgtctctgtttttttattttccagaaaatcagttcgaggaaagggaaaggggcaaaaacgaaagcgcaagaaatcccggtataagtcctggagcgtgtacgttggtgcccgctgctgtctaatgccctggagcctccctggcccccagtacaacctccgcctgccattccctgtaaccctgcctccctcccctggtccctccctggctctcatcctcctggcccgtgtctctctctcactctctcactccactaattggcaccaacgggtagatttggtggtggcattgctggtccagggttggggtgaatgggggtgccgacttggcctggaggattaagggaggggaccctggcttggctgggcaccgattttctctcacccactgggcactggtggcgggcccatgttggcacaggtgcctgctcacccaactggtttccattgctctaggcttctgcactcgtctggaagctgagggtggtggggagggcagacatggcccaagaagggctgtgaatgactggaggcagcttgctgaatgactccttggctgaaggaggagcttgggtgggatcagacaccatgtggcggcctcccttcatctggtggaagtgccctggctcctcacggaggtggggcctctggaggggagccccctattccggcccaacccatggcacccacagaggcctccttgcagggcagcctcttcctctgggtcggaggctgtggtgggccctgccctgggccctctggccaccagcggcctgaccctggggacactgcctccgggcttagcctcccatcacaccctactttagcccaccttggtggaagggcctggacatgagccttgcacggggagaaggtggcccctgattgccatccccagcaggtgaagagtcaaggcgtgctccgatgggggcaacagcagttgggtccctgtggcctgagactcacccttgtctcccagagacacagcattgccccttatggcagcctctccctgcactctctgcccgtctgtgcccgcctcttcctgcggcaggtgtcctagccagtgctgcctctttccgccgctctctctgtcttttgctgtagcgctcggatccttccagggcctgggggctgaccggctgggtgggggtgcagctgcggacatgttagggggtgttgcatggtgattttttttctctctctctgctgatgctctagcttagatgtctttccttttgcctttttgcagtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcaggttggttcccagagggcaagcaagtcagagaggggcatcacacagagatggggagagagagagagaaagagagtgagcgagcgagcgagcgggagagcgcctgagaggggccagctgcttgctcagtttctagctgcctgcctggtgactgctgccttctctgcttttaaggcccctgtggtgggctgcaggcactggtccagcctggcggggcctgttccgaggttgccctggttgcctgagtggtaggctggtgtggcttagtgtagtggtgtggacgcaagctgtgtgttgtgtcctgtggtccttctgctcatagtggctgttggtcctgatgttattactacctctggtagtaatgctgagaagctgaaagccgattccaggtgtggacaatgtcaacaaagcacagatgctctcgctggggccttgcctcggccctttgaagtctgcatggctgggcttctcactcactcagtgtttcttgctgggggaaggaattgagtctcccacttcagactgggcctccctgaggaaagggttgtgtctccccactcagactgaggttccctgagggtagggctgtgtctctcccctccgacctgggctccctgatagggctgtctccccgctcagactgaggctccctcaggccagggctatgtctccctcctcagactggggctctgagggcaaggggtctggctgttcgtttaggatggggcagttttgcctacacactgaaggagctgtagcatccaagaatactagatacctttaatcctccaccagtcatggtgacaaccccaagcagcccacacattttcaagtgcccccaggatgcgtggagggaggggtctgtgcccattctcctgacattagcctgtgagctccgtaagcccgggcctcgtttacgtacctttgtgagccccgggcatctgtacctctttcctttgcccatactggggaccaaggaagtgtcaagtgcatgagtgaatgtgtgactcagttcagagggtgaggtcaggagcacagggtcgggacaggtggctggcatcttttaatgccttagcttatgttctttataccaacttggcctgtgctcagagtgagggaggccctgggggtcagggtaagcgtcagtcagggaggcaagactttgtggggatttcctagacagggccaaggcacccccagctcaccccgaggctgcgttagggaagtccttggagtgtctcccctcccccagcaatgttcttgtggcttgtgtgtgctcaggggatgctgggaaccaggcctgggtagttggtgtggggtgctgtctgtcttggccctatgtgaaaccaagagggcgtatattagtgctggggtgggggctctgcctaacttcagggctggatgaggggagtctcagttccccaggggtccttgggaaagataagggacttgacattttagggtttttaggtgattattctgctgatgggggtttgtgtgaagtgacctgggagctaactgaagttactctaacctcccaatacctttacccaacccccaagctggctgtatctgggaatatcagtttccaaaattggaggcttaggactccgtttcggggctccccagaagggtagggcctgttctgcctccttctcacaatcacccaggggcaggggcatgctgagaaagttcttggaggccccctttgcttcagctggagtagtgaagccgccgaattgtctctccccatcctaagtgaagcagcatatttgaaaggaaagacaacctgttacctgggcctgcaacctccaggcagctcaagagagatgaggcctacagccacactgggaggggacatggggaatggagatggtccctcaccttcctggggcctcctgctctacgctaccccctcgggagcctcctgtccccagggtcaggcccttgccattgttggtcacccggccaagcctctctgcctcaggcgttctcccagaagatctgcccactctcttccccacaccagcccctagagactgaactgaaaaccctcctcagcagggagcctcttctgattaacttcatccagctctggtcacccatcagctcttaaaatgtcaagtggggactgttctttggtatccgttcatttgttgctttgtaaagtgttcccatgtccttgtcttgtctcaagtagattgcaagctcaggagggtagactgggagcccctgagtggagctgctgctcaggccggggctccctgagggcagggctggggctgttctcatactggggctttctgccccaggaccacaccttcctgtcctctctgctcttatggtgccggaggctgcagtgacccaggggcccccaggaatggggaggccgcctgcctcatcgccaggcctcctcacttggccctaaccccagcctttgttttccatttccctcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaagctcctc

SEQ ID NO: 429 - DNA, 7382 bp, Homo sapiens
  misc_feature (1041)..(1472): CDS
atcggcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcagaccaaagaaagatagagcaagacaagaaaagtaagtggccctgactttagcacttctccctctccatggccggttgtcttggtttggggctcttggctacctctgttgggggctcccatagcctccctgggtcagggacttggtcttgtgggggacttgtggtggcagcaacaatgggatggagccaactccaggatgatggctctagggctagtgagaaaacatagccaggagcctggcacttcctttggaagggacaatgccttctgggtctccagatcattcctgaccaggacttgctgtttcggtgtgtcagggggcactgtggacactggctcactggcttgctctaggacacccacagtggggagagggagtgggtggcagagaggccagcttttgtgtgtcagaggaaatggcctcttttggtggctgctgtgacggtgcagttggatgcgaggccggctggagggtggtttctcagtgcatgccctcctgtaggcggcaggcggcagacacacagccctcttggccagggagaaaaagttgaatgttggtcattttcagaggcttgtgagtgctccgtgttaaggggcaggtaggatggggtgggggacaaggtctggcggcagtaacccttcaagacagggtgggcggctggcatcagcaagagcttgcagggaaagagagactgagagagagcacctgtgccctgccctttcccccacaccatcttgtctgcctccagtgctgtgcggacattgaagcccccaccaggcctcaaccccttgcctcttccctcagctcccagcttccagagcgaggggatgcggaaaccttccttccaccctttggtgctttctcctaagggggacagacttgccctctctggtcccttctccccctcctttcttccctgtgacagacatcctgaggtgtgttctcttgggcttggcaggcatggagagctctggttctcttgaaggggacaggctacagcctgccccccttcctgtttccccaaatgactgctctgccatggggagagtagggggctcgcctgggctcggaagagtgtctggtgagatggtgtagcaggctttgacaggctggggagagaactccctgccaagtaccgcccaagcctctcctccccagacctccttaactcccaccccatcctgctgcctgcccagggctccaggacacccagccctgcctcccagtccaggtcgtgctgagcaggctggtgttgctcttggttccgtgccagctcccaaggtagccgcttcccccacaccgggattcccagaggttctgtcgcagttgcaaatgaaggcacaaggtgcctgatacacagccctccctcccactcctgctccccatccaggcaggtctctgaccttctccccaaagtctggcctaccttttatcacccccggaccttcagggtcagacttggacagggctgctgggcaaagagccttccctcaggctttgccccctgccggggactgggagccactgtgagtgtggagacctttgggtcctgtgccctccacccagtctcggcttcccaccaaagccttgtcaggggctgggtttgccatcccatggtgggcagcgtgaggagaagaaagagccatcgagtgcttgctgcccagacacgcctgtgtgcgcccgcgcatgcctccccagagaccacctgcctcctgacacttcctccgggaagcggccctgtgtggctttgctttggtcgttcccccatccctgcccaccttaccacttcttttactccccccaccgcccccgctctctctctgtctctgtttttttattttccagaaaatcagttcgaggaaagggaaaggggcaaaaacgaaagcgcaagaaatcccggtataagtcctggagcgtgtacgttggtgcccgctgctgtctaatgccctggagcctccctggcccccagtacaacctccgcctgccattccctgtaaccctgcctccctcccctggtccctccctggctctcatcctcctggcccgtgtctctctctcactctctcactccactaattggcaccaacgggtagatttggtggtggcattgctggtccagggttggggtgaatgggggtgccgacttggcctggaggattaagggaggggaccctggcttggctgggcaccgattttctctcacccactgggcactggtggcgggcccatgttggcacaggtgcctgctcacccaactggtttccattgctctaggcttctgcactcgtctggaagctgagggtggtggggagggcagacatggcccaagaagggctgtgaatgactggaggcagcttgctgaatgactccttggctgaaggaggagcttgggtgggatcagacaccatgtggcggcctcccttcatctggtggaagtgccctggctcctcacggaggtggggcctctggaggggagccccctattccggcccaacccatggcacccacagaggcctccttgcagggcagcctcttcctctgggtcggaggctgtggtgggccctgccctgggccctctggccaccagcggcctgaccctggggacactgcctccgggcttagcctcccatcacaccctactttagcccaccttggtggaagggcctggacatgagccttgcacggggagaaggtggcccctgattgccatccccagcaggtgaagagtcaaggcgtgctccgatgggggcaacagcagttgggtccctgtggcctgagactcacccttgtctcccagagacacagcattgccccttatggcagcctctccctgcactctctgcccgtctgtgcccgcctcttcctgcggcaggtgtcctagccagtgctgcctctttccgccgctctctctgtcttttgctgtagcgctcggatccttccagggcctgggggctgaccggctgggtgggggtgcagctgcggacatgttagggggtgttgcatggtgattttttttctctctctctgctgatgctctagcttagatgtctttccttttgcctttttgcagtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaagctcctc

SEQ ID NO: 430 - DNA, 6229 bp, Homo sapiens
  misc_feature (1041)..(1472): CDS
atcggcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcagaccaaagaaagatagagcaagacaagaaaagtaagtggccctgactttagcacttctccctctccatggccggttgtcttggtttggggctcttggctacctctgttgggggctcccatagcctccctgggtcagggacttggtcttgtgggggacttgtggtggcagcaacaatgggatggagccaactccaggatgatggctctagggctagtgagaaaacatagccaggagcctggcacttcctttggaagggacaatgccttctgggtctccagatcattcctgaccaggacttgctgtttcggtgtgtcagggggcactgtggacactggctcactggcttgctctaggacacccacagtggggagagggagtgggtggcagagaggccagcttttgtgtgtcagaggaaatggcctcttttggtggctgctgtgacggtgcagttggatgcgaggccggctggagggtggtttctcagtgcatgccctcctgtaggcggcaggcggcagacacacagccctcttggccagggagaaaaagttgaatgttggtcattttcagaggcttgtgagtgctccgtgttaaggggcaggtaggatggggtgggggacaaggtctggcggcagtaacccttcaagacagggtgggcggctggcatcagcaagagcttgcagggaaagagagactgagagagagcacctgtgccctgccctttcccccacaccatcttgtctgcctccagtgctgtgcggacattgaagcccccaccaggcctcaaccccttgcctcttccctcagctcccagcttccagagcgaggggatgcggaaaccttccttccaccctttggtgctttctcctaagggggacagacttgccctctctggtcccttctccccctcctttcttccctgtgacagacatcctgaggtgtgttctcttgggcttggcaggcatggagagctctggttctcttgaaggggacaggctacagcctgccccccttcctgtttccccaaatgactgctctgccatggggagagtagggggctcgcctgggctcggaagagtgtctggtgagatggtgtagcaggctttgacaggctggggagagaactccctgccaagtaccgcccaagcctctcctccccagacctccttaactcccaccccatcctgctgcctgcccagggctccaggacacccagccctgcctcccagtccaggtcgtgctgagcaggctggtgttgctcttggttccgtgccagctcccaaggtagccgcttcccccacaccgggattcccagaggttctgtcgcagttgcaaatgaaggcacaaggtgcctgatacacagccctccctcccactcctgctccccatccaggcaggtctctgaccttctccccaaagtctggcctaccttttatcacccccggaccttcagggtcagacttggacagggctgctgggcaaagagccttccctcaggctttgccccctgccggggactgggagccactgtgagtgtggagacctttgggtcctgtgccctccacccagtctcggcttcccaccaaagccttgtcaggggctgggtttgccatcccatggtgggcagcgtgaggagaagaaagagccatcgagtgcttgctgcccagacacgcctgtgtgcgcccgcgcatgcctccccagagaccacctgcctcctgacacttcctccgggaagcggccctgtgtggctttgctttggtcgttcccccatccctgcccaccttaccacttcttttactccccccaccgcccccgctctctctctgtctctgtttttttattttccagaaaatcagttcgaggaaagggaaaggggcaaaaacgaaagcgcaagaaatcccggtataagtcctggagcgttccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaagctcctc

SEQ ID NO: 431 - DNA, 8708 bp, Homo sapiens
  misc_feature (1041)..(1472): CDS
atcggcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcagaccaaagaaagatagagcaagacaagaaaaacctccttaactcccaccccatcctgctgcctgcccagggctccaggacacccagccctgcctcccagtccaggtcgtgctgagcaggctggtgttgctcttggttccgtgccagctcccaaggtagccgcttcccccacaccgggattcccagaggttctgtcgcagttgcaaatgaaggcacaaggtgcctgatacacagccctccctcccactcctgctccccatccaggcaggtctctgaccttctccccaaagtctggcctaccttttatcacccccggaccttcagggtcagacttggacagggctgctgggcaaagagccttccctcaggctttgccccctgccggggactgggagccactgtgagtgtggagacctttgggtcctgtgccctccacccagtctcggcttcccaccaaagccttgtcaggggctgggtttgccatcccatggtgggcagcgtgaggagaagaaagagccatcgagtgcttgctgcccagacacgcctgtgtgcgcccgcgcatgcctccccagagaccacctgcctcctgacacttcctccgggaagcggccctgtgtggctttgctttggtcgttcccccatccctgcccaccttaccacttcttttactccccccaccgcccccgctctctctctgtctctgtttttttattttccagaaaatcagttcgaggaaagggaaaggggcaaaaacgaaagcgcaagaaatcccggtataagtcctggagcgtgtacgttggtgcccgctgctgtctaatgccctggagcctccctggcccccagtacaacctccgcctgccattccctgtaaccctgcctccctcccctggtccctccctggctctcatcctcctggcccgtgtctctctctcactctctcactccactaattggcaccaacgggtagatttggtggtggcattgctggtccagggttggggtgaatgggggtgccgacttggcctggaggattaagggaggggaccctggcttggctgggcaccgattttctctcacccactgggcactggtggcgggcccatgttggcacaggtgcctgctcacccaactggtttccattgctctaggcttctgcactcgtctggaagctgagggtggtggggagggcagacatggcccaagaagggctgtgaatgactggaggcagcttgctgaatgactccttggctgaaggaggagcttgggtgggatcagacaccatgtggcggcctcccttcatctggtggaagtgccctggctcctcacggaggtggggcctctggaggggagccccctattccggcccaacccatggcacccacagaggcctccttgcagggcagcctcttcctctgggtcggaggctgtggtgggccctgccctgggccctctggccaccagcggcctgaccctggggacactgcctccgggcttagcctcccatcacaccctactttagcccaccttggtggaagggcctggacatgagccttgcacggggagaaggtggcccctgattgccatccccagcaggtgaagagtcaaggcgtgctccgatgggggcaacagcagttgggtccctgtggcctgagactcacccttgtctcccagagacacagcattgccccttatggcagcctctccctgcactctctgcccgtctgtgcccgcctcttcctgcggcaggtgtcctagccagtgctgcctctttccgccgctctctctgtcttttgctgtagcgctcggatccttccagggcctgggggctgaccggctgggtgggggtgcagctgcggacatgttagggggtgttgcatggtgattttttttctctctctctgctgatgctctagcttagatgtctttccttttgcctttttgcagtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcaggttggttcccagagggcaagcaagtcagagaggggcatcacacagagatggggagagagagagagaaagagagtgagcgagcgagcgagcgggagagcgcctgagaggggccagctgcttgctcagtttctagctgcctgcctggtgactgctgccttctctgcttttaaggcccctgtggtgggctgcaggcactggtccagcctggcggggcctgttccgaggttgccctggttgcctgagtggtaggctggtgtggcttagtgtagtggtgtggacgcaagctgtgtgttgtgtcctgtggtccttctgctcatagtggctgttggtcctgatgttattactacctctggtagtaatgctgagaagctgaaagccgattccaggtgtggacaatgtcaacaaagcacagatgctctcgctggggccttgcctcggccctttgaagtctgcatggctgggcttctcactcactcagtgtttcttgctgggggaaggaattgagtctcccacttcagactgggcctccctgaggaaagggttgtgtctccccactcagactgaggttccctgagggtagggctgtgtctctcccctccgacctgggctccctgatagggctgtctccccgctcagactgaggctccctcaggccagggctatgtctccctcctcagactggggctctgagggcaaggggtctggctgttcgtttaggatggggcagttttgcctacacactgaaggagctgtagcatccaagaatactagatacctttaatcctccaccagtcatggtgacaaccccaagcagcccacacattttcaagtgcccccaggatgcgtggagggaggggtctgtgcccattctcctgacattagcctgtgagctccgtaagcccgggcctcgtttacgtacctttgtgagccccgggcatctgtacctctttcctttgcccatactggggaccaaggaagtgtcaagtgcatgagtgaatgtgtgactcagttcagagggtgaggtcaggagcacagggtcgggacaggtggctggcatcttttaatgccttagcttatgttctttataccaacttggcctgtgctcagagtgagggaggccctgggggtcagggtaagcgtcagtcagggaggcaagactttgtggggatttcctagacagggccaaggcacccccagctcaccccgaggctgcgttagggaagtccttggagtgtctcccctcccccagcaatgttcttgtggcttgtgtgtgctcaggggatgctgggaaccaggcctgggtagttggtgtggggtgctgtctgtcttggccctatgtgaaaccaagagggcgtatattagtgctggggtgggggctctgcctaacttcagggctggatgaggggagtctcagttccccaggggtccttgggaaagataagggacttgacattttagggtttttaggtgattattctgctgatgggggtttgtgtgaagtgacctgggagctaactgaagttactctaacctcccaatacctttacccaacccccaagctggctgtatctgggaatatcagtttccaaaattggaggcttaggactccgtttcggggctccccagaagggtagggcctgttctgcctccttctcacaatcacccaggggcaggggcatgctgagaaagttcttggaggccccctttgcttcagctggagtagtgaagccgccgaattgtctctccccatcctaagtgaagcagcatatttgaaaggaaagacaacctgttacctgggcctgcaacctccaggcagctcaagagagatgaggcctacagccacactgggaggggacatggggaatggagatggtccctcaccttcctggggcctcctgctctacgctaccccctcgggagcctcctgtccccagggtcaggcccttgccattgttggtcacccggccaagcctctctgcctcaggcgttctcccagaagatctgcccactctcttccccacaccagcccctagagactgaactgaaaaccctcctcagcagggagcctcttctgattaacttcatccagctctggtcacccatcagctcttaaaatgtcaagtggggactgttctttggtatccgttcatttgttgctttgtaaagtgttcccatgtccttgtcttgtctcaagtagattgcaagctcaggagggtagactgggagcccctgagtggagctgctgctcaggccggggctccctgagggcagggctggggctgttctcatactggggctttctgccccaggaccacaccttcctgtcctctctgctcttatggtgccggaggctgcagtgacccaggggcccccaggaatggggaggccgcctgcctcatcgccaggcctcctcacttggccctaaccccagcctttgttttccatttccctcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaagctcctc

SEQ ID NO: 432 - DNA, 6211 bp, Homo sapiens
  misc_feature (1041)..(1472): CDS
atcggcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcagaccaaagaaagatagagcaagacaagaaaagtaagtggccctgactttagcacttctccctctccatggccggttgtcttggtttggggctcttggctacctctgttgggggctcccatagcctccctgggtcagggacttggtcttgtgggggacttgtggtggcagcaacaatgggatggagccaactccaggatgatggctctagggctagtgagaaaacatagccaggagcctggcacttcctttggaagggacaatgccttctgggtctccagatcattcctgaccaggacttgctgtttcggtgtgtcagggggcactgtggacactggctcactggcttgctctaggacacccacagtggggagagggagtgggtggcagagaggccagcttttgtgtgtcagaggaaatggcctcttttggtggctgctgtgacggtgcagttggatgcgaggccggctggagggtggtttctcagtgcatgccctcctgtaggcggcaggcggcagacacacagccctcttggccagggagaaaaagttgaatgttggtcattttcagaggcttgtgagtgctccgtgttaaggggcaggtaggatggggtgggggacaaggtctggcggcagtaacccttcaagacagggtgggcggctggcatcagcaagagcttgcagggaaagagagactgagagagagcacctgtgccctgccctttcccccacaccatcttgtctgcctccagtgctgtgcggacattgaagcccccaccaggcctcaaccccttgcctcttccctcagctcccagcttccagagcgaggggatgcggaaaccttccttccaccctttggtgctttctcctaagggggacagacttgccctctctggtcccttctccccctcctttcttccctgtgacagacatcctgaggtgtgttctcttgggcttggcaggcatggagagctctggttctcttgaaggggacaggctacagcctgccccccttcctgtttccccaaatgactgctctgccatggggagagtagggggctcgcctgggctcggaagagtgtctggtgagatggtgtagcaggctttgacaggctggggagagaactccctgccaagtaccgcccaagcctctcctccccagacctccttaactcccaccccatcctgctgcctgcccagggctccaggacacccagccctgcctcccagtccaggtcgtgctgagcaggctggtgttgctcttggttccgtgccagctcccaaggtagccgcttcccccacaccgggattcccagaggttctgtcgcagttgcaaatgaaggcacaaggtgcctgatacacagccctccctcccactcctgctccccatccaggcaggtctctgaccttctccccaaagtctggcctaccttttatcacccccggaccttcagggtcagacttggacagggctgctgggcaaagagccttccctcaggctttgccccctgccggggactgggagccactgtgagtgtggagacctttgggtcctgtgccctccacccagtctcggcttcccaccaaagccttgtcaggggctgggtttgccatcccatggtgggcagcgtgaggagaagaaagagccatcgagtgcttgctgcccagacacgcctgtgtgcgcccgcgcatgcctccccagagaccacctgcctcctgacacttcctccgggaagcggccctgtgtggctttgctttggtcgttcccccatccctgcccaccttaccacttcttttactccccccaccgcccccgctctctctctgtctctgtttttttattttccagaaaatcagttcgaggaaagggaaaggggcaaaaacgaaagcgcaagaaatcccgtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaagctcctc

SEQ ID NO: 433 - DNA, 6097 bp, Homo sapiens
  misc_feature (1041)..(1472): CDS
atcggcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcagaccaaagaaagatagagcaagacaagaaaagtaagtggccctgactttagcacttctccctctccatggccggttgtcttggtttggggctcttggctacctctgttgggggctcccatagcctccctgggtcagggacttggtcttgtgggggacttgtggtggcagcaacaatgggatggagccaactccaggatgatggctctagggctagtgagaaaacatagccaggagcctggcacttcctttggaagggacaatgccttctgggtctccagatcattcctgaccaggacttgctgtttcggtgtgtcagggggcactgtggacactggctcactggcttgctctaggacacccacagtggggagagggagtgggtggcagagaggccagcttttgtgtgtcagaggaaatggcctcttttggtggctgctgtgacggtgcagttggatgcgaggccggctggagggtggtttctcagtgcatgccctcctgtaggcggcaggcggcagacacacagccctcttggccagggagaaaaagttgaatgttggtcattttcagaggcttgtgagtgctccgtgttaaggggcaggtaggatggggtgggggacaaggtctggcggcagtaacccttcaagacagggtgggcggctggcatcagcaagagcttgcagggaaagagagactgagagagagcacctgtgccctgccctttcccccacaccatcttgtctgcctccagtgctgtgcggacattgaagcccccaccaggcctcaaccccttgcctcttccctcagctcccagcttccagagcgaggggatgcggaaaccttccttccaccctttggtgctttctcctaagggggacagacttgccctctctggtcccttctccccctcctttcttccctgtgacagacatcctgaggtgtgttctcttgggcttggcaggcatggagagctctggttctcttgaaggggacaggctacagcctgccccccttcctgtttccccaaatgactgctctgccatggggagagtagggggctcgcctgggctcggaagagtgtctggtgagatggtgtagcaggctttgacaggctggggagagaactccctgccaagtaccgcccaagcctctcctccccagacctccttaactcccaccccatcctgctgcctgcccagggctccaggacacccagccctgcctcccagtccaggtcgtgctgagcaggctggtgttgctcttggttccgtgccagctcccaaggtagccgcttcccccacaccgggattcccagaggttctgtcgcagttgcaaatgaaggcacaaggtgcctgatacacagccctccctcccactcctgctccccatccaggcaggtctctgaccttctccccaaagtctggcctaccttttatcacccccggaccttcagggtcagacttggacagggctgctgggcaaagagccttccctcaggctttgccccctgccggggactgggagccactgtgagtgtggagacctttgggtcctgtgccctccacccagtctcggcttcccaccaaagccttgtcaggggctgggtttgccatcccatggtgggcagcgtgaggagaagaaagagccatcgagtgcttgctgcccagacacgcctgtgtgcgcccgcgcatgcctccccagagaccacctgcctcctgacacttcctccgggaagcggccctgtgtggctttgctttggtcgttcccccatccctgcccaccttaccacttcttttactccccccaccgcccccgctctctctctgtctctgtttttttattttccagaaaatcagttcgaggaaagggaaaggggcaaaaacgaaagcgcaagaaatcccggtataagtcctggagcgtatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaagctcctc

SEQ ID NO: 434 - DNA, 6796 bp, Homo sapiens
  misc_feature (1041)..(1472): CDS
atcggcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcaggttggttcccagagggcaagcaagtcagagaggggcatcacacagagatggggagagagagagagaaagagagtgagcgagcgagcgagcgggagagcgcctgagaggggccagctgcttgctcagtttctagctgcctgcctggtgactgctgccttctctgcttttaaggcccctgtggtgggctgcaggcactggtccagcctggcggggcctgttccgaggttgccctggttgcctgagtggtaggctggtgtggcttagtgtagtggtgtggacgcaagctgtgtgttgtgtcctgtggtccttctgctcatagtggctgttggtcctgatgttattactacctctggtagtaatgctgagaagctgaaagccgattccaggtgtggacaatgtcaacaaagcacagatgctctcgctggggccttgcctcggccctttgaagtctgcatggctgggcttctcactcactcagtgtttcttgctgggggaaggaattgagtctcccacttcagactgggcctccctgaggaaagggttgtgtctccccactcagactgaggttccctgagggtagggctgtgtctctcccctccgacctgggctccctgatagggctgtctccccgctcagactgaggctccctcaggccagggctatgtctccctcctcagactggggctctgagggcaaggggtctggctgttcgtttaggatggggcagttttgcctacacactgaaggagctgtagcatccaagaatactagatacctttaatcctccaccagtcatggtgacaaccccaagcagcccacacattttcaagtgcccccaggatgcgtggagggaggggtctgtgcccattctcctgacattagcctgtgagctccgtaagcccgggcctcgtttacgtacctttgtgagccccgggcatctgtacctctttcctttgcccatactggggaccaaggaagtgtcaagtgcatgagtgaatgtgtgactcagttcagagggtgaggtcaggagcacagggtcgggacaggtggctggcatcttttaatgccttagcttatgttctttataccaacttggcctgtgctcagagtgagggaggccctgggggtcagggtaagcgtcagtcagggaggcaagactttgtggggatttcctagacagggccaaggcacccccagctcaccccgaggctgcgttagggaagtccttggagtgtctcccctcccccagcaatgttcttgtggcttgtgtgtgctcaggggatgctgggaaccaggcctgggtagttggtgtggggtgctgtctgtcttggccctatgtgaaaccaagagggcgtatattagtgctggggtgggggctctgcctaacttcagggctggatgaggggagtctcagttccccaggggtccttgggaaagataagggacttgacattttagggtttttaggtgattattctgctgatgggggtttgtgtgaagtgacctgggagctaactgaagttactctaacctcccaatacctttacccaacccccaagctggctgtatctgggaatatcagtttccaaaattggaggcttaggactccgtttcggggctccccagaagggtagggcctgttctgcctccttctcacaatcacccaggggcaggggcatgctgagaaagttcttggaggccccctttgcttcagctggagtagtgaagccgccgaattgtctctccccatcctaagtgaagcagcatatttgaaaggaaagacaacctgttacctgggcctgcaacctccaggcagctcaagagagatgaggcctacagccacactgggaggggacatggggaatggagatggtccctcaccttcctggggcctcctgctctacgctaccccctcgggagcctcctgtccccagggtcaggcccttgccattgttggtcacccggccaagcctctctgcctcaggcgttctcccagaagatctgcccactctcttccccacaccagcccctagagactgaactgaaaaccctcctcagcagggagcctcttctgattaacttcatccagctctggtcacccatcagctcttaaaatgtcaagtggggactgttctttggtatccgttcatttgttgctttgtaaagtgttcccatgtccttgtcttgtctcaagtagattgcaagctcaggagggtagactgggagcccctgagtggagctgctgctcaggccggggctccctgagggcagggctggggctgttctcatactggggctttctgccccaggaccacaccttcctgtcctctctgctcttatggtgccggaggctgcagtgacccaggggcccccaggaatggggaggccgcctgcctcatcgccaggcctcctcacttggccctaaccccagcctttgttttccatttccctcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaagctcctc

SEQ ID NO: 435 - DNA, 6868 bp, Homo sapiens
  misc_feature (1041)..(1472): CDS
atcggcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgttccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcaggttggttcccagagggcaagcaagtcagagaggggcatcacacagagatggggagagagagagagaaagagagtgagcgagcgagcgagcgggagagcgcctgagaggggccagctgcttgctcagtttctagctgcctgcctggtgactgctgccttctctgcttttaaggcccctgtggtgggctgcaggcactggtccagcctggcggggcctgttccgaggttgccctggttgcctgagtggtaggctggtgtggcttagtgtagtggtgtggacgcaagctgtgtgttgtgtcctgtggtccttctgctcatagtggctgttggtcctgatgttattactacctctggtagtaatgctgagaagctgaaagccgattccaggtgtggacaatgtcaacaaagcacagatgctctcgctggggccttgcctcggccctttgaagtctgcatggctgggcttctcactcactcagtgtttcttgctgggggaaggaattgagtctcccacttcagactgggcctccctgaggaaagggttgtgtctccccactcagactgaggttccctgagggtagggctgtgtctctcccctccgacctgggctccctgatagggctgtctccccgctcagactgaggctccctcaggccagggctatgtctccctcctcagactggggctctgagggcaaggggtctggctgttcgtttaggatggggcagttttgcctacacactgaaggagctgtagcatccaagaatactagatacctttaatcctccaccagtcatggtgacaaccccaagcagcccacacattttcaagtgcccccaggatgcgtggagggaggggtctgtgcccattctcctgacattagcctgtgagctccgtaagcccgggcctcgtttacgtacctttgtgagccccgggcatctgtacctctttcctttgcccatactggggaccaaggaagtgtcaagtgcatgagtgaatgtgtgactcagttcagagggtgaggtcaggagcacagggtcgggacaggtggctggcatcttttaatgccttagcttatgttctttataccaacttggcctgtgctcagagtgagggaggccctgggggtcagggtaagcgtcagtcagggaggcaagactttgtggggatttcctagacagggccaaggcacccccagctcaccccgaggctgcgttagggaagtccttggagtgtctcccctcccccagcaatgttcttgtggcttgtgtgtgctcaggggatgctgggaaccaggcctgggtagttggtgtggggtgctgtctgtcttggccctatgtgaaaccaagagggcgtatattagtgctggggtgggggctctgcctaacttcagggctggatgaggggagtctcagttccccaggggtccttgggaaagataagggacttgacattttagggtttttaggtgattattctgctgatgggggtttgtgtgaagtgacctgggagctaactgaagttactctaacctcccaatacctttacccaacccccaagctggctgtatctgggaatatcagtttccaaaattggaggcttaggactccgtttcggggctccccagaagggtagggcctgttctgcctccttctcacaatcacccaggggcaggggcatgctgagaaagttcttggaggccccctttgcttcagctggagtagtgaagccgccgaattgtctctccccatcctaagtgaagcagcatatttgaaaggaaagacaacctgttacctgggcctgcaacctccaggcagctcaagagagatgaggcctacagccacactgggaggggacatggggaatggagatggtccctcaccttcctggggcctcctgctctacgctaccccctcgggagcctcctgtccccagggtcaggcccttgccattgttggtcacccggccaagcctctctgcctcaggcgttctcccagaagatctgcccactctcttccccacaccagcccctagagactgaactgaaaaccctcctcagcagggagcctcttctgattaacttcatccagctctggtcacccatcagctcttaaaatgtcaagtggggactgttctttggtatccgttcatttgttgctttgtaaagtgttcccatgtccttgtcttgtctcaagtagattgcaagctcaggagggtagactgggagcccctgagtggagctgctgctcaggccggggctccctgagggcagggctggggctgttctcatactggggctttctgccccaggaccacaccttcctgtcctctctgctcttatggtgccggaggctgcagtgacccaggggcccccaggaatggggaggccgcctgcctcatcgccaggcctcctcacttggccctaaccccagcctttgttttccatttccctcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaagctcctc

SEQ ID NO: 436 - DNA, 4210 bp, Homo sapiens
  misc_feature (1041)..(1472): CDS
atcggcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcagaccaaagaaagatagagcaagacaagaaaaatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaagctcctc

SEQ ID NO: 437 - DNA, 4342 bp, Homo sapiens
  misc_feature (1041)..(1472): CDS
atcggcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaagctcctc

SEQ ID NO: 438 - DNA, 4414 bp, Homo sapiens
  misc_feature (1041)..(1472): CDS
atcggcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgttccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaagctcctc

SEQ ID NO: 439 - DNA, 4396 bp, Homo sapiens
  misc_feature (1041)..(1472): CDS
atcggcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccgtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaagctcctc

SEQ ID NO: 440 - DNA, 4360 bp, Homo sapiens
  misc_feature (1041)..(1472): CDS
atcggcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgttccctgtgggccttgctcagagcggagaaagcatttgtttgtacaagatccgcagacgtgtaaatgttcttccctcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaagctcctc

SEQ ID NO: 441 - DNA, 9599 bp, Homo sapiens
  misc_feature (1041)..(1472): CDS
atcggcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcagaccaaagaaagatagagcaagacaagaaaagtaagtggccctgactttagcacttctccctctccatggccggttgtcttggtttggggctcttggctacctctgttgggggctcccatagcctccctgggtcagggacttggtcttgtgggggacttgtggtggcagcaacaatgggatggagccaactccaggatgatggctctagggctagtgagaaaacatagccaggagcctggcacttcctttggaagggacaatgccttctgggtctccagatcattcctgaccaggacttgctgtttcggtgtgtcagggggcactgtggacactggctcactggcttgctctaggacacccacagtggggagagggagtgggtggcagagaggccagcttttgtgtgtcagaggaaatggcctcttttggtggctgctgtgacggtgcagttggatgcgaggccggctggagggtggtttctcagtgcatgccctcctgtaggcggcaggcggcagacacacagccctcttggccagggagaaaaagttgaatgttggtcattttcagaggcttgtgagtgctccgtgttaaggggcaggtaggatggggtgggggacaaggtctggcggcagtaacccttcaagacagggtgggcggctggcatcagcaagagcttgcagggaaagagagactgagagagagcacctgtgccctgccctttcccccacaccatcttgtctgcctccagtgctgtgcggacattgaagcccccaccaggcctcaaccccttgcctcttccctcagctcccagcttccagagcgaggggatgcggaaaccttccttccaccctttggtgctttctcctaagggggacagacttgccctctctggtcccttctccccctcctttcttccctgtgacagacatcctgaggtgtgttctcttgggcttggcaggcatggagagctctggttctcttgaaggggacaggctacagcctgccccccttcctgtttccccaaatgactgctctgccatggggagagtagggggctcgcctgggctcggaagagtgtctggtgagatggtgtagcaggctttgacaggctggggagagaactccctgccaagtaccgcccaagcctctcctccccagacctccttaactcccaccccatcctgctgcctgcccagggctccaggacacccagccctgcctcccagtccaggtcgtgctgagcaggctggtgttgctcttggttccgtgccagctcccaaggtagccgcttcccccacaccgggattcccagaggttctgtcgcagttgcaaatgaaggcacaaggtgcctgatacacagccctccctcccactcctgctccccatccaggcaggtctctgaccttctccccaaagtctggcctaccttttatcacccccggaccttcagggtcagacttggacagggctgctgggcaaagagccttccctcaggctttgccccctgccggggactgggagccactgtgagtgtggagacctttgggtcctgtgccctccacccagtctcggcttcccaccaaagccttgtcaggggctgggtttgccatcccatggtgggcagcgtgaggagaagaaagagccatcgagtgcttgctgcccagacacgcctgtgtgcgcccgcgcatgcctccccagagaccacctgcctcctgacacttcctccgggaagcggccctgtgtggctttgctttggtcgttcccccatccctgcccaccttaccacttcttttactccccccaccgcccccgctctctctctgtctctgtttttttattttccagaaaatcagttcgaggaaagggaaaggggcaaaaacgaaagcgcaagaaatcccggtataagtcctggagcgtgtacgttggtgcccgctgctgtctaatgccctggagcctccctggcccccagtacaacctccgcctgccattccctgtaaccctgcctccctcccctggtccctccctggctctcatcctcctggcccgtgtctctctctcactctctcactccactaattggcaccaacgggtagatttggtggtggcattgctggtccagggttggggtgaatgggggtgccgacttggcctggaggattaagggaggggaccctggcttggctgggcaccgattttctctcacccactgggcactggtggcgggcccatgttggcacaggtgcctgctcacccaactggtttccattgctctaggcttctgcactcgtctggaagctgagggtggtggggagggcagacatggcccaagaagggctgtgaatgactggaggcagcttgctgaatgactccttggctgaaggaggagcttgggtgggatcagacaccatgtggcggcctcccttcatctggtggaagtgccctggctcctcacggaggtggggcctctggaggggagccccctattccggcccaacccatggcacccacagaggcctccttgcagggcagcctcttcctctgggtcggaggctgtggtgggccctgccctgggccctctggccaccagcggcctgaccctggggacactgcctccgggcttagcctcccatcacaccctactttagcccaccttggtggaagggcctggacatgagccttgcacggggagaaggtggcccctgattgccatccccagcaggtgaagagtcaaggcgtgctccgatgggggcaacagcagttgggtccctgtggcctgagactcacccttgtctcccagagacacagcattgccccttatggcagcctctccctgcactctctgcccgtctgtgcccgcctcttcctgcggcaggtgtcctagccagtgctgcctctttccgccgctctctctgtcttttgctgtagcgctcggatccttccagggcctgggggctgaccggctgggtgggggtgcagctgcggacatgttagggggtgttgcatggtgattttttttctctctctctgctgatgctctagcttagatgtctttccttttgcctttttgcagtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcaggttggttcccagagggcaagcaagtcagagaggggcatcacacagagatggggagagagagagagaaagagagtgagcgagcgagcgagcgggagagcgcctgagaggggccagctgcttgctcagtttctagctgcctgcctggtgactgctgccttctctgcttttaaggcccctgtggtgggctgcaggcactggtccagcctggcggggcctgttccgaggttgccctggttgcctgagtggtaggctggtgtggcttagtgtagtggtgtggacgcaagctgtgtgttgtgtcctgtggtccttctgctcatagtggctgttggtcctgatgttattactacctctggtagtaatgctgagaagctgaaagccgattccaggtgtggacaatgtcaacaaagcacagatgctctcgctggggccttgcctcggccctttgaagtctgcatggctgggcttctcactcactcagtgtttcttgctgggggaaggaattgagtctcccacttcagactgggcctccctgaggaaagggttgtgtctccccactcagactgaggttccctgagggtagggctgtgtctctcccctccgacctgggctccctgatagggctgtctccccgctcagactgaggctccctcaggccagggctatgtctccctcctcagactggggctctgagggcaaggggtctggctgttcgtttaggatggggcagttttgcctacacactgaaggagctgtagcatccaagaatactagatacctttaatcctccaccagtcatggtgacaaccccaagcagcccacacattttcaagtgcccccaggatgcgtggagggaggggtctgtgcccattctcctgacattagcctgtgagctccgtaagcccgggcctcgtttacgtacctttgtgagccccgggcatctgtacctctttcctttgcccatactggggaccaaggaagtgtcaagtgcatgagtgaatgtgtgactcagttcagagggtgaggtcaggagcacagggtcgggacaggtggctggcatcttttaatgccttagcttatgttctttataccaacttggcctgtgctcagagtgagggaggccctgggggtcagggtaagcgtcagtcagggaggcaagactttgtggggatttcctagacagggccaaggcacccccagctcaccccgaggctgcgttagggaagtccttggagtgtctcccctcccccagcaatgttcttgtggcttgtgtgtgctcaggggatgctgggaaccaggcctgggtagttggtgtggggtgctgtctgtcttggccctatgtgaaaccaagagggcgtatattagtgctggggtgggggctctgcctaacttcagggctggatgaggggagtctcagttccccaggggtccttgggaaagataagggacttgacattttagggtttttaggtgattattctgctgatgggggtttgtgtgaagtgacctgggagctaactgaagttactctaacctcccaatacctttacccaacccccaagctggctgtatctgggaatatcagtttccaaaattggaggcttaggactccgtttcggggctccccagaagggtagggcctgttctgcctccttctcacaatcacccaggggcaggggcatgctgagaaagttcttggaggccccctttgcttcagctggagtagtgaagccgccgaattgtctctccccatcctaagtgaagcagcatatttgaaaggaaagacaacctgttacctgggcctgcaacctccaggcagctcaagagagatgaggcctacagccacactgggaggggacatggggaatggagatggtccctcaccttcctggggcctcctgctctacgctaccccctcgggagcctcctgtccccagggtcaggcccttgccattgttggtcacccggccaagcctctctgcctcaggcgttctcccagaagatctgcccactctcttccccacaccagcccctagagactgaactgaaaaccctcctcagcagggagcctcttctgattaacttcatccagctctggtcacccatcagctcttaaaatgtcaagtggggactgttctttggtatccgttcatttgttgctttgtaaagtgttcccatgtccttgtcttgtctcaagtagattgcaagctcaggagggtagactgggagcccctgagtggagctgctgctcaggccggggctccctgagggcagggctggggctgttctcatactggggctttctgccccaggaccacaccttcctgtcctctctgctcttatggtgccggaggctgcagtgacccaggggcccccaggaatggggaggccgcctgcctcatcgccaggcctcctcacttggccctaaccccagcctttgttttccatttccctcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatacta

SEQ ID NO: 442 - DNA, 2472 bp, Homo sapiens
  misc_feature (1041)..(1472): CDS
atcggcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcaggtgaggatgtagtcacggattcattatcagcaagtggctgcagggtgcctgatctgtgccagggttaagcatgctgtactttttggcccccgtccagcttcccgctatgtgacctttggcattttacttcaatgtgcctcagtttctacatctgtaaaatgggcacaatagtagtatacttcatagcattgttataatgattaaacaagttatatatgaaaagattaaaacagtgttgctccataa

SEQ ID NO: 443 - DNA, 1678 bp, Homo sapiens
  misc_feature (1041)..(1436): CDS
atcggcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcaggtgaggatgtagtcacggattcattatcagcaagtggctgcagggtgcctgatctgtgccagggttaagcatgctgtactttttggcccccgtccagcttcccgctatgtgacctttggcattttacttcaatgtgcctcagtttctacatctgtaaaatgggcacaatagtagtatacttcatagcattgttataatgattaaacaagttatatatgaaaagattaaaacagtgttgctccataa

SEQ ID NO: 444 - DNA, 308 bp, Homo sapiens
atcggcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaac

SEQ ID NO: 445 - DNA, 164 bp, Homo sapiens
cagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccc

SEQ ID NO: 446 - DNA, 140 bp, Homo sapiens
cttgggatcccgcagctgaccagtcgcgctgacggacagacagacagacaccgcccccagccccagctaccacctcctccccggccggcggcggacagtggacgcggcggcgagccgcgggcaggggccggagcccgcgc

SEQ ID NO: 447 - DNA, 494 bp, Homo sapiens
ccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaag

SEQ ID NO: 448 - DNA, 197 bp, Homo sapiens
tggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcag

SEQ ID NO: 449 - DNA, 611 bp, Homo sapiens
gtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctcc

SEQ ID NO: 450 - DNA, 246 bp, Homo sapiens
gtgaggatgtagtcacggattcattatcagcaagtggctgcagggtgcctgatctgtgccagggttaagcatgctgtactttttggcccccgtccagcttcccgctatgtgacctttggcattttacttcaatgtgcctcagtttctacatctgtaaaatgggcacaatagtagtatacttcatagcattgttataatgattaaacaagttatatatgaaaagattaaaacagtgttgctccataa

SEQ ID NO: 451 - DNA, 1058 bp, Homo sapiens
ctctgttgggggctcccatagcctccctgggtcagggacttggtcttgtgggggacttgtggtggcagcaacaatgggatggagccaactccaggatgatggctctagggctagtgagaaaacatagccaggagcctggcacttcctttggaagggacaatgccttctgggtctccagatcattcctgaccaggacttgctgtttcggtgtgtcagggggcactgtggacactggctcactggcttgctctaggacacccacagtggggagagggagtgggtggcagagaggccagcttttgtgtgtcagaggaaatggcctcttttggtggctgctgtgacggtgcagttggatgcgaggccggctggagggtggtttctcagtgcatgccctcctgtaggcggcaggcggcagacacacagccctcttggccagggagaaaaagttgaatgttggtcattttcagaggcttgtgagtgctccgtgttaaggggcaggtaggatggggtgggggacaaggtctggcggcagtaacccttcaagacagggtgggcggctggcatcagcaagagcttgcagggaaagagagactgagagagagcacctgtgccctgccctttcccccacaccatcttgtctgcctccagtgctgtgcggacattgaagcccccaccaggcctcaaccccttgcctcttccctcagctcccagcttccagagcgaggggatgcggaaaccttccttccaccctttggtgctttctcctaagggggacagacttgccctctctggtcccttctccccctcctttcttccctgtgacagacatcctgaggtgtgttctcttgggcttggcaggcatggagagctctggttctcttgaaggggacaggctacagcctgccccccttcctgtttccccaaatgactgctctgccatggggagagtagggggctcgcctgggctcggaagagtgtctggtgagatggtgtagcaggctttgacaggctggggagagaactccctgccaagtaccgcccaagcctctcctccccag

SEQ ID NO: 452 - DNA, 204 bp, Homo sapiens
tcccaccccatcctgctgcctgcccagggctccaggacacccagccctgcctcccagtccaggtcgtgctgagcaggctggtgttgctcttggttccgtgccagctcccaaggtagccgcttcccccacaccgggattcccagaggttctgtcgcagttgcaaatgaaggcacaaggtgcctgatacacagccctccctcccac

SEQ ID NO: 453 - DNA, 472 bp, Homo sapiens
tcctgctccccatccaggcaggtctctgaccttctccccaaagtctggcctaccttttatcacccccggaccttcagggtcagacttggacagggctgctgggcaaagagccttccctcaggctttgccccctgccggggactgggagccactgtgagtgtggagacctttgggtcctgtgccctccacccagtctcggcttcccaccaaagccttgtcaggggctgggtttgccatcccatggtgggcagcgtgaggagaagaaagagccatcgagtgcttgctgcccagacacgcctgtgtgcgcccgcgcatgcctccccagagaccacctgcctcctgacacttcctccgggaagcggccctgtgtggctttgctttggtcgttcccccatccctgcccaccttaccacttcttttactccccccaccgcccccgctctctctctgtctctgtttttttattttccag

SEQ ID NO: 454 - DNA, 1102 bp, Homo sapiens
gtacaacctccgcctgccattccctgtaaccctgcctccctcccctggtccctccctggctctcatcctcctggcccgtgtctctctctcactctctcactccactaattggcaccaacgggtagatttggtggtggcattgctggtccagggttggggtgaatgggggtgccgacttggcctggaggattaagggaggggaccctggcttggctgggcaccgattttctctcacccactgggcactggtggcgggcccatgttggcacaggtgcctgctcacccaactggtttccattgctctaggcttctgcactcgtctggaagctgagggtggtggggagggcagacatggcccaagaagggctgtgaatgactggaggcagcttgctgaatgactccttggctgaaggaggagcttgggtgggatcagacaccatgtggcggcctcccttcatctggtggaagtgccctggctcctcacggaggtggggcctctggaggggagccccctattccggcccaacccatggcacccacagaggcctccttgcagggcagcctcttcctctgggtcggaggctgtggtgggccctgccctgggccctctggccaccagcggcctgaccctggggacactgcctccgggcttagcctcccatcacaccctactttagcccaccttggtggaagggcctggacatgagccttgcacggggagaaggtggcccctgattgccatccccagcaggtgaagagtcaaggcgtgctccgatgggggcaacagcagttgggtccctgtggcctgagactcacccttgtctcccagagacacagcattgccccttatggcagcctctccctgcactctctgcccgtctgtgcccgcctcttcctgcggcaggtgtcctagccagtgctgcctctttccgccgctctctctgtcttttgctgtagcgctcggatccttccagggcctgggggctgaccggctgggtgggggtgcagctgcggacatgttagggggtgttgcatggtgattttttttctctctctctgctgatgctctagcttagatgtctttccttttgcctttttgcag

SEQ ID NO: 455 - DNA, 2445 bp, Homo sapiens
gttggttcccagagggcaagcaagtcagagaggggcatcacacagagatggggagagagagagagaaagagagtgagcgagcgagcgagcgggagagcgcctgagaggggccagctgcttgctcagtttctagctgcctgcctggtgactgctgccttctctgcttttaaggcccctgtggtgggctgcaggcactggtccagcctggcggggcctgttccgaggttgccctggttgcctgagtggtaggctggtgtggcttagtgtagtggtgtggacgcaagctgtgtgttgtgtcctgtggtccttctgctcatagtggctgttggtcctgatgttattactacctctggtagtaatgctgagaagctgaaagccgattccaggtgtggacaatgtcaacaaagcacagatgctctcgctggggccttgcctcggccctttgaagtctgcatggctgggcttctcactcactcagtgtttcttgctgggggaaggaattgagtctcccacttcagactgggcctccctgaggaaagggttgtgtctccccactcagactgaggttccctgagggtagggctgtgtctctcccctccgacctgggctccctgatagggctgtctccccgctcagactgaggctccctcaggccagggctatgtctccctcctcagactggggctctgagggcaaggggtctggctgttcgtttaggatggggcagttttgcctacacactgaaggagctgtagcatccaagaatactagatacctttaatcctccaccagtcatggtgacaaccccaagcagcccacacattttcaagtgcccccaggatgcgtggagggaggggtctgtgcccattctcctgacattagcctgtgagctccgtaagcccgggcctcgtttacgtacctttgtgagccccgggcatctgtacctctttcctttgcccatactggggaccaaggaagtgtcaagtgcatgagtgaatgtgtgactcagttcagagggtgaggtcaggagcacagggtcgggacaggtggctggcatcttttaatgccttagcttatgttctttataccaacttggcctgtgctcagagtgagggaggccctgggggtcagggtaagcgtcagtcagggaggcaagactttgtggggatttcctagacagggccaaggcacccccagctcaccccgaggctgcgttagggaagtccttggagtgtctcccctcccccagcaatgttcttgtggcttgtgtgtgctcaggggatgctgggaaccaggcctgggtagttggtgtggggtgctgtctgtcttggccctatgtgaaaccaagagggcgtatattagtgctggggtgggggctctgcctaacttcagggctggatgaggggagtctcagttccccaggggtccttgggaaagataagggacttgacattttagggtttttaggtgattattctgctgatgggggtttgtgtgaagtgacctgggagctaactgaagttactctaacctcccaatacctttacccaacccccaagctggctgtatctgggaatatcagtttccaaaattggaggcttaggactccgtttcggggctccccagaagggtagggcctgttctgcctccttctcacaatcacccaggggcaggggcatgctgagaaagttcttggaggccccctttgcttcagctggagtagtgaagccgccgaattgtctctccccatcctaagtgaagcagcatatttgaaaggaaagacaacctgttacctgggcctgcaacctccaggcagctcaagagagatgaggcctacagccacactgggaggggacatggggaatggagatggtccctcaccttcctggggcctcctgctctacgctaccccctcgggagcctcctgtccccagggtcaggcccttgccattgttggtcacccggccaagcctctctgcctcaggcgttctcccagaagatctgcccactctcttccccacaccagcccctagagactgaactgaaaaccctcctcagcagggagcctcttctgattaacttcatccagctctggtcacccatcagctcttaaaatgtcaagtggggactgttctttggtatccgttcatttgttgctttgtaaagtgttcccatgtccttgtcttgtctcaagtagattgcaagctcaggagggtagactgggagcccctgagtggagctgctgctcaggccggggctccctgagggcagggctggggctgttctcatactggggctttctgccccaggaccacaccttcctgtcctctctgctcttatggtgccggaggctgcagtgacccaggggcccccaggaatggggaggccgcctgcctcatcgccaggcctcctcacttggccctaaccccagcctttgttttccat

SEQ ID NO: 456 - DNA, 283 bp, Homo sapiens
atctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattc

SEQ ID NO: 457 - DNA, 175 bp, Homo sapiens
ctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgg

SEQ ID NO: 458 - DNA, 134 bp, Homo sapiens
tcagatcctgacagggaagaggaggagatgagagactctggcatgatcttttttttgtcccacttggtggggccagggtcctctcccctgcccaggaatgtgcaaggccagggcatgggggcaaatatgaccca

SEQ ID NO: 459 - DNA, 183 bp, Homo sapiens
cttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaag

SEQ ID NO: 460 - DNA, 141 bp, Homo sapiens
cttatcttgaacagatatttaattttgctaacactcagctctgccctccccgatcccctggctccccagcacacattcctttgaaataaggtttcaatatacatctacatactatatatatatttggcaacttgtatttgt

SEQ ID NO: 461 - DNA, 194 bp, Homo sapiens
gtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcac

SEQ ID NO: 462 - DNA, 140 bp, Homo sapiens
gtctttgtctctagtgcagtttttcgagatattccgtagtacatatttatttttaaacaacgacaaagaaatacagatatatcttaaaaaaaaaaaagcattttgtattaaagaatttaattctgatctcaaagctcctc

SEQ ID NO: 463 - DNA, 52 bp, Homo sapiens
tggtcccaggctgcacccatggcagaaggaggagggcagaatcatcacgaag

SEQ ID NO: 464 - DNA, 63 bp, Homo sapiens
gtgggcatctttgggaagtggggcaagggggggatagggaggggggtaacactttgggaacag

SEQ ID NO: 465 - DNA, 88 bp, Homo sapiens
accacccatccctgctctgcagaacccctgggtgctgagtggcaggagccccagggttgtcccatctgggtatggctggctgggtcac

SEQ ID NO: 466 - DNA, 32 bp, Homo sapiens
taacctctgtgatctgcttccttcctttccag

SEQ ID NO: 467 - DNA, 54 bp, Homo sapiens
attatgcggatcaaacctcaccaaggccagcacataggagagatgagcttccta

SEQ ID NO: 468 - DNA, 23 bp, Homo sapiens
cagcacaacaaatgtgaatgcag

SEQ ID NO: 469 - DNA, 30 bp, Homo sapiens
accaaagaaagatagagcaagacaagaaaa

SEQ ID NO: 470 - DNA, 70 bp, Homo sapiens
gtaagtggccctgactttagcacttctccctctccatggccggttgtcttggtttggggctcttggctac

SEQ ID NO: 471 - DNA, 11 bp, Homo sapiens
acctccttaac

SEQ ID NO: 472 - DNA, 54 bp, Homo sapiens
aaaatcagttcgaggaaagggaaaggggcaaaaacgaaagcgcaagaaatcccg

SEQ ID NO: 473 - DNA, 18 bp, Homo sapiens
gtataagtcctggagcgt

SEQ ID NO: 474 - DNA, 51 bp, Homo sapiens
gtacgttggtgcccgctgctgtctaatgccctggagcctccctggccccca

SEQ ID NO: 475 - DNA, 69 bp, Homo sapiens
tccctgtgggccttgctcagagcggagaaagcatttgtttgtacaagatccgcagacgtgtaaatgttc

SEQ ID NO: 476 - DNA, 28 bp, Homo sapiens
ctgcaaaaacacagactcgcgttgcaag

SEQ ID NO: 477 - DNA, 35 bp, Homo sapiens
gcgaggcagcttgagttaaacgaacgtacttgcag

SEQ ID NO: 478 - DNA, 9 bp, Homo sapiens
ttccctcag

SEQ ID NO: 479 - DNA, 66 bp, Homo sapiens
atgtgacaagccgaggcggtgagccgggcaggaggaaggagcctccctcagggtttcgggaaccag

SEQ ID NO: 480 - DNA, 5 bp, Homo sapiens
gaggg

SEQ ID NO: 481 - DNA, 12 bp, Homo sapiens
gaatgttcccac

SEQ ID NO: 482 - DNA, 111 bp, Homo sapiens
gttttgggaacaccgacaaacccagccctggcgctgagcctctctaccccaggtcagacggacagaaagacagatcacaggtacagggatgaggacaccggctctgaccag

SEQ ID NO: 483 - DNA, 12 bp, Homo sapiens
gagtttggggag

SEQ ID NO: 484 - DNA, 25 bp, Homo sapiens
aagcagcccatgacagctccccttc

SEQ ID NO: 485 - DNA, 24 bp, Homo sapiens
ctgggactcgccctcatcctcttc

SEQ ID NO: 486 - DNA, 12 bp, Homo sapiens
ctgctccccttc

SEQ ID NO: 487 - DNA, 29 bp, Homo sapiens
ctggggtgcagcctaaaaggacctatgtc

SEQ ID NO: 488 - DNA, 16 bp, Homo sapiens
ctcacaccattgaaac

SEQ ID NO: 489 - DNA, 87 bp, Homo sapiens
cactagttctgtccccccaggagacctggttgtgtgtgtgtgagtggttgaccttcctccatcccctggtccttcccttcccttccc

SEQ ID NO: 490 - DNA, 99 bp, Homo sapiens
gaggcacagagagacagggcaggatccacgtgcccattgtggaggcagagaaaagagaaagtgttttatatacggtacttatttaatatccctttttaa

SEQ ID NO: 491 - DNA, 58 bp, Homo sapiens
ttagaaattaaaacagttaatttaattaaagagtagggttttttttcagtattcttgg

SEQ ID NO: 492 - DNA, 73 bp, Homo sapiens
ttaatatttaatttcaactatttatgagatgtatcttttgctctctcttgctctcttatttgtaccggttttt

SEQ ID NO: 493 - DNA, 55 bp, Homo sapiens
gtatataaaattcatgtttccaatctctctctccctgatcggtgacagtcactag

SEQ ID NO: 494 - DNA, 20 bp, Homo sapiens
gtgtatatatatatatatat

SEQ ID NO: 495 - protein, 143 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQVGIFGKWGKGGIGRGVTLWEQVVPGRFLARFALSGSCP

SEQ ID NO: 496 - protein, 131 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECR

SEQ ID NO: 497 - DNA, 6603 bp, Homo sapiens
  misc_feature (315)..(2018): CDS
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagaattgtcaaactttgagtgccttcatccttgctctcaggaatagaattctacctcatcggatctcatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagaggtgagcactgcaacaaaaaggctgttttctctcggatctccaaatttaaaagcacaaggaatgattgtaccacacaaagtaatgtaaaacattaaaggactcattaaaaagtaacagttgtctcatatcatcttgatttattgtcactgttgctaactttcaggctcggaggagatgctcctcccaaaatgagttcggagatgatagcagtaataatgagacccccgggccccagctctgggccccccattcaggccgagggggctgctccggggggccgacttggtgcacgtttggatttggaggatccctgcactgccttctctgtgtttgttgctcttgctgttttctcctgcctgataaacaacaacttgggatgatcctttccttccattttgatgccaacctctttttatttttaagtgttgaagctgcacaaactgaataatttaaacaaatgctggtttctgccaaagatggacacgaataagttaattttccagctcagaatgagtacagttgaatttgagactctgtcggacttctgcctggttttatttgggactatttcatctgctcttgatttgtaaatagcacctggatagcaagttataatgcttatttatttgaaaatgctttttttttttttacgttaagcacatttatcttgaactggagcttctaaaatgggccccaggggtgcaagatgttggtgtaattcagagatagtaaaggtttatcgcagtgtgaattataagagtccatccaaatcaacgtcccctccctcctctcatgcgatccaggtaattatgcagttagtgccacagtagactagcctagcaaagggtttgctccttgctgtctctgactgcaccacacagctattgatggcagctgaaagaaagtggatcatgccttaattttaaatattcctgtcctctggttattattttaaggaacttcatcatgttaaaatgacagcattcaaaggtgtaccacaatcaatttatcaaggaaataaaggctattgtaaccagagatttaatgcattcttctaaatgtaaatttaaaatttgccctttaaaaaagtccactttccccatatgcaaatgttaataggatttttatggggattaagaagcggcaaaactacagaagcagaattcaaagtaatttaaaaaatacacaccagttttaaatcaagagaagttgtaatctcttgttttaagcttgcgtttgagggaaaatgactttttcaccaatttaatatgcattgttctgttgtttttatttatgattgatcattatatgtgacttgcataaactatttaaaaaaaaaaactataatgaccaaaatagccatggctgagaaacacagtggctgggcagttcaataggaggtgacaatatgacaacttctcaagcttgggaactcaccagactgtttcctcctttaggtaacagattctgtcccacggctaaacttgtctttcacgtgggaattgcttttgtcaaacgtgaaagagtaaacaatagcatttccccagaatgccagttttatggagccccaaatgctctgaaaacaattagtaacctggaagttgtcagcccaaaggaaagaaaaatcaattgtatcttgaaattttacctatggctctttggcctggcttctttgttcattataagttagtgtgttccttcaggaaacaatgccttaataccatagaacatgggggccttaatagttgctaacattaaaaaagcaaacagaatgattgagggatccttatgaaaacaaaatggtgaattggacatgcagaacctaccatttccttcccctgtttgcaatttttgtggggaggggaggatgttagtatttacaaaagatgattttaagaacttccaagagatgagtttaagaattccatagagtattagttgttcactgtgtaattaatccttccggagagtcttttttttttttttttaaagaaacttttgggtgggttttgttttttattagttaccctaggggtatgttaccctggggtatgaagggaggtgaagataacggaggggggagaaaaaaaaaagaagaaaaaaggagcctaaaatggggaataattgaaatggaacagggggtgtgaggctggttcctcagtccccattccaaacggaggatagaagctgtgtatttatgtgacctggcagatctctggggccataacactgaaaagtgaaagaacctggtgggcagctatctttggctactgataaccagcagaaatgtctgttaattctgattttctcaatttgaagggatcagctacactgttaaattttggaaagccactacctacttccatcaagtaacttaggtttcgaaatatgggttcaacgcacctcccttattcaaaatgtcaaaatagattattataatgtataaagtaagaattgacaaaatatgattcttgggttgattggtcatttagaaactagccaaaagtgagacttttaatgtagaacatttttcagaaatgggtacaaagaaaaatgcatattactgtatatttcagagtgtttatgtgaaccttgtatttaattgagagtcccatgtacgttctgcagcctttttgctgcttctatcatctgaagtttgtgtagtacaaataaggcctttgggattcttaatgacatttatgttaaaatgttctcttctctttaaacaccgttttccaatccacctgtcagggagtccaaatcgtgtctgtgttgatgatgctatactttgtagctagaaaaacaattttagtgttgtgggctctgtattcagacttcctttttacaagaccgatgggcagtgatagattattttatcatatttaatgcatgggaaatagtgtgctgaggaagctattaaaagtataactcagtgaattgggtctgagttttaaatgagatatttcaaaattggcttgccactgtaaaagcgactaaataataatatgatactgttctttatgatcttgtcatgtttcactgatatgtttggggtcttcactatgtaaaaaatgtcaaaattgtaatgagcaagcatgtacaagtagtcgtaaatcaaaggttttaaacaggactgcattttcaattaggaaaagctgtttggcagatagcatccaatgcaaaaacagaaatatcgtaacgttctgcttagtgggcaagataagataggaaagacatgctcaaagaggcaaaagaatcattgctatcattcattctacactagtttgaagaagtttttgtacatcagagcacttccttcagcacacttttttgccttcagttttcattttttataaaatgagaagactaatgataaactgtagaaatcaaaatttattgagaaatctgtttctcctaacagatagtaaccctgccatgatatactacttcaacaatgttataaaagttatgtgataatatacattttaacctgggatttctaaattgctttaacaaatgctaatcctgagagttgccctgcaggactcaaaagggaaaggttttgggacgtggcagaaccctgcagggacatggaattaaggccattgcaatgtatcatctttgtagcattgtcatcactcctaagctgccttcacagttttagtacactaagatgaggaaatcgaaaatgggcagagaaagctcatactgtataattgaagacagtgacagagaacgtgtcagttatgccaaaactcttttgatttctgttccaggatttccaacaagaggggaaaggaatgacttgggagggtgggaaagacattaggagttgtttttattttttaccttggaagctttagctaccaatccagtaccctcctaactagaatgtatacacatcagcaggactgactgactacttcattagagatatactgtactcattgggggccttgggggtactgctgttcttatgtgggattttaatgttgtaatgtattgcatcttaatgtattgaattcattttgttgtactatattggttggcattttattaaaataaattgtattgtatcatatttgtatgttttaagagaaaataatataaaatacaatatttgtactattatatagtgcaaaaactacaaatctgtgcctctgcctcttgaattaattctttggttgcttgcatttgggaagggaatggagaaaggaaagaaccaataaagctttcaaagttcaagaaaaaatcc

SEQ ID NO: 498 - DNA, 6623 bp, Homo sapiens
  misc_feature (315)..(1940): CDS
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagcttccaccagctaacagttctttcatgttgccacctacaagcttctcttccaactacttccatttccttccgtgactctaaacggatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagaggtgagcactgcaacaaaaaggctgttttctctcggatctccaaatttaaaagcacaaggaatgattgtaccacacaaagtaatgtaaaacattaaaggactcattaaaaagtaacagttgtctcatatcatcttgatttattgtcactgttgctaactttcaggctcggaggagatgctcctcccaaaatgagttcggagatgatagcagtaataatgagacccccgggccccagctctgggccccccattcaggccgagggggctgctccggggggccgacttggtgcacgtttggatttggaggatccctgcactgccttctctgtgtttgttgctcttgctgttttctcctgcctgataaacaacaacttgggatgatcctttccttccattttgatgccaacctctttttatttttaagtgttgaagctgcacaaactgaataatttaaacaaatgctggtttctgccaaagatggacacgaataagttaattttccagctcagaatgagtacagttgaatttgagactctgtcggacttctgcctggttttatttgggactatttcatctgctcttgatttgtaaatagcacctggatagcaagttataatgcttatttatttgaaaatgctttttttttttttacgttaagcacatttatcttgaactggagcttctaaaatgggccccaggggtgcaagatgttggtgtaattcagagatagtaaaggtttatcgcagtgtgaattataagagtccatccaaatcaacgtcccctccctcctctcatgcgatccaggtaattatgcagttagtgccacagtagactagcctagcaaagggtttgctccttgctgtctctgactgcaccacacagctattgatggcagctgaaagaaagtggatcatgccttaattttaaatattcctgtcctctggttattattttaaggaacttcatcatgttaaaatgacagcattcaaaggtgtaccacaatcaatttatcaaggaaataaaggctattgtaaccagagatttaatgcattcttctaaatgtaaatttaaaatttgccctttaaaaaagtccactttccccatatgcaaatgttaataggatttttatggggattaagaagcggcaaaactacagaagcagaattcaaagtaatttaaaaaatacacaccagttttaaatcaagagaagttgtaatctcttgttttaagcttgcgtttgagggaaaatgactttttcaccaatttaatatgcattgttctgttgtttttatttatgattgatcattatatgtgacttgcataaactatttaaaaaaaaaaactataatgaccaaaatagccatggctgagaaacacagtggctgggcagttcaataggaggtgacaatatgacaacttctcaagcttgggaactcaccagactgtttcctcctttaggtaacagattctgtcccacggctaaacttgtctttcacgtgggaattgcttttgtcaaacgtgaaagagtaaacaatagcatttccccagaatgccagttttatggagccccaaatgctctgaaaacaattagtaacctggaagttgtcagcccaaaggaaagaaaaatcaattgtatcttgaaattttacctatggctctttggcctggcttctttgttcattataagttagtgtgttccttcaggaaacaatgccttaataccatagaacatgggggccttaatagttgctaacattaaaaaagcaaacagaatgattgagggatccttatgaaaacaaaatggtgaattggacatgcagaacctaccatttccttcccctgtttgcaatttttgtggggaggggaggatgttagtatttacaaaagatgattttaagaacttccaagagatgagtttaagaattccatagagtattagttgttcactgtgtaattaatccttccggagagtcttttttttttttttttaaagaaacttttgggtgggttttgttttttattagttaccctaggggtatgttaccctggggtatgaagggaggtgaagataacggaggggggagaaaaaaaaaagaagaaaaaaggagcctaaaatggggaataattgaaatggaacagggggtgtgaggctggttcctcagtccccattccaaacggaggatagaagctgtgtatttatgtgacctggcagatctctggggccataacactgaaaagtgaaagaacctggtgggcagctatctttggctactgataaccagcagaaatgtctgttaattctgattttctcaatttgaagggatcagctacactgttaaattttggaaagccactacctacttccatcaagtaacttaggtttcgaaatatgggttcaacgcacctcccttattcaaaatgtcaaaatagattattataatgtataaagtaagaattgacaaaatatgattcttgggttgattggtcatttagaaactagccaaaagtgagacttttaatgtagaacatttttcagaaatgggtacaaagaaaaatgcatattactgtatatttcagagtgtttatgtgaaccttgtatttaattgagagtcccatgtacgttctgcagcctttttgctgcttctatcatctgaagtttgtgtagtacaaataaggcctttgggattcttaatgacatttatgttaaaatgttctcttctctttaaacaccgttttccaatccacctgtcagggagtccaaatcgtgtctgtgttgatgatgctatactttgtagctagaaaaacaattttagtgttgtgggctctgtattcagacttcctttttacaagaccgatgggcagtgatagattattttatcatatttaatgcatgggaaatagtgtgctgaggaagctattaaaagtataactcagtgaattgggtctgagttttaaatgagatatttcaaaattggcttgccactgtaaaagcgactaaataataatatgatactgttctttatgatcttgtcatgtttcactgatatgtttggggtcttcactatgtaaaaaatgtcaaaattgtaatgagcaagcatgtacaagtagtcgtaaatcaaaggttttaaacaggactgcattttcaattaggaaaagctgtttggcagatagcatccaatgcaaaaacagaaatatcgtaacgttctgcttagtgggcaagataagataggaaagacatgctcaaagaggcaaaagaatcattgctatcattcattctacactagtttgaagaagtttttgtacatcagagcacttccttcagcacacttttttgccttcagttttcattttttataaaatgagaagactaatgataaactgtagaaatcaaaatttattgagaaatctgtttctcctaacagatagtaaccctgccatgatatactacttcaacaatgttataaaagttatgtgataatatacattttaacctgggatttctaaattgctttaacaaatgctaatcctgagagttgccctgcaggactcaaaagggaaaggttttgggacgtggcagaaccctgcagggacatggaattaaggccattgcaatgtatcatctttgtagcattgtcatcactcctaagctgccttcacagttttagtacactaagatgaggaaatcgaaaatgggcagagaaagctcatactgtataattgaagacagtgacagagaacgtgtcagttatgccaaaactcttttgatttctgttccaggatttccaacaagaggggaaaggaatgacttgggagggtgggaaagacattaggagttgtttttattttttaccttggaagctttagctaccaatccagtaccctcctaactagaatgtatacacatcagcaggactgactgactacttcattagagatatactgtactcattgggggccttgggggtactgctgttcttatgtgggattttaatgttgtaatgtattgcatcttaatgtattgaattcattttgttgtactatattggttggcattttattaaaataaattgtattgtatcatatttgtatgttttaagagaaaataatataaaatacaatatttgtactattatatagtgcaaaaactacaaatctgtgcctctgcctcttgaattaattctttggttgcttgcatttgggaagggaatggagaaaggaaagaaccaataaagctttcaaagttcaagaaaaaatcc

SEQ ID NO: 499 - DNA, 3903 bp, Homo sapiens
  misc_feature (315)..(2516): CDS
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctgaactgtatacatcaacgtcaccatcgtcatcgtcatcatcaccattgtcatcatcatcatcatcgtcatcatcatcatcatcatagctatcatcattatcatcatcatcatcatcatcatcatagctaccatttattgaaaactattatgtgtcaacttcaaagaacttatcctttagttggagagccaagacaatcataacaataacaaatggccgggcatggtggctcacgcctgtaatcccagcactttgggaggccaaggcaggtggatcatttgaggtcaggagttcaagaccagcctgaccaagatggtgaaatgctgtctctattaaaaatacaaaattagccgggcatggtggctcatgcctgtaatgccagctactcgggaggctgagacaggagaatcacttgaacccaggaggcagaggttgcagggagccgagatcgtgtactgcactccagcctgggcaacaagagcgaaactccgtctcaaaaaacaaataaataaataaataaataaacagacaaaattcactttttattctattaaacttaacatacatgcattaattgcctactctgagcctgatcctttattatattctagagaaaatgaaaataagcaacacataatcctcacctttgaaaaacaaacataataggtacaaagtcagttcataaatgtgcaatgtgagtggtataaaataacatcagataaaaattagcacttctgatgactaatcaggggagatttcatggaggagatgtcatctgaattggactttgatgaataaaaaagagagttttgatgacgaatattagtttggccaaagtggatgaatataatgttctctaagtcaacaatacagatagtcaactgagcaacaaaacagaagttgctggtcagactagtaggcccatttaggagagcaacaagccacttttgtgtgtgggggggaacaggaggcaaacacatggcctgcatttatgtaatcaaataggtgaattcaaaagctctacagatttatttactcaatggtgaattggattaaaattatattccatgctcttccctgggcaatatggtgctcacacataaaatgccaagattgtccttcaccttaaggtataatgggaagaaataaagctatctacagagtcccttgaaaattacacctttaaaattgacagttggacatcttgaaaatttagaccacatcccatgaataaattaggccatcatggtcaaaaacttatccacatcctccattagcaaccaacataataagtaattcaaatcctcacactgagtttcatcgtcagatactttagaggacaccacacgtttctacaaaaacagcccagtgtaaagttttacttgtccttttggggctaatgctttagcaaacgcataaaaccaccagagtttgcattctaagctccaggaactgaggctttttgaaccttaaga

SEQ ID NO: 500 - DNA, 2623 bp, Homo sapiens
  misc_feature (315)..(2471): CDS
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggctctgcaaatacagcagtgaacaagaaaactgaaatctgaagaaccaaaaatctagagtaattaagtgatgcatgtatttacctgaaatacgcttcttcaagcaacaaccctgtgtgtcctgccttattcgctattatcgtgtcaattggtctaaaaatggaataaggcaaattaataaatgggcaatcaga

SEQ ID NO: 501 - DNA, 2712 bp, Homo sapiens
  misc_feature (315)..(2525): CDS
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggtaagagacttttttttcttccatttattatttctcatctttcatcagcccccctttcccttaacagtcccgtcacctgcttccagtatgtatagacctacttgctgatagagccccaaacactgggatctggttcatgctgatagcaatgtccagtgaggaatatttgggccagttcctatgcagaccatattcctaacccatagaaagatcctgcagaatctattcagctggaagtctttaaatagtgcattcagaaagaaatgagaagagccatgtaga

SEQ ID NO: 502 - DNA, 3045 bp, Homo sapiens
  misc_feature (315)..(2471): CDS
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggctctgcaaatacagcagtgaacaagaaaactgaaatctgaagaaccaaaaatctagagtaattaagtgatgcatgtatttacctgaaatacgcttcttcaagcaacaaccctgtgtgtcctgccttattcgctattatcgtgtcaattggtctaaaaatggaataaggcaaattaataaatgggcaatcagaaaaattctatggctcaatcatggtatcaaaatatctttaatacattggatagctgaaaagatacaccctttgtgctttaattttcctatgttcatgctgtgcatacaataagttctcaattgttgttagctgtatatacagaaaggaggaagagataaggggaaattagtaggggctccaaattagaactgagtaaagaagcaactgggaactcttagaagggactgatgtggtgcaaagtgttgaaagatgaaggtaatttaagacctatttactttgaagaggcaggtgaaaagagagtagacaagctgaagtgaatataatacagagagccagagataagagaggaaaatgcagtgtgaagggactaataccaagaagcaccacacaagagttcaaagtcagagatgaatcctgtttga

SEQ ID NO: 503 - DNA, 2819 bp, Homo sapiens
  misc_feature (315)..(1958): CDS
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagtatttggatataaggactgaggaacagattttttcctttattcagaagactcagacattgaaactcactgtctcatgcaaagctgccttctagtccagccagactacactgatctacaatttgcacctgagctcctttctctggccctataaagtttaaattttaattgtcaaataattttatttttaatgagaaaatgtttgaatttataatttaaaaatatatcccctgaaagagaagtactctagaaatgagataaattttaataaaactgatcataggatatgtttcaccttatttttaacttttcttctttagtgataaccattgtatttatcaaatatattttcaaaccacataacaacagttgaagagcagcttgcagcttatgtaaaatgtcatcagagaagccaactagtatttctgtaaatagtagtagtatttaatttatgttacccatctctgcggattaaaggaagtattctcaaggaaaaattcaattaaaggtgtagacagaattttgccaatagatctgtgttattcaacttaaagagtctcaaggcgagaagcaatctggtgtagagattaggagcataggcacggaggcagacacacctgagcataaattctgcccaggcctgtctgtggtcctttgcatctttgggtgaatcatctaatctctcggaacctcagttgtcctacctgtagaatagggtaatatacccatctcacagggttttggggaggattaaatgagacaattcctgtaaagtgccttgcatgctgcctggtgcattgtaaggcatacataaaggttcgcagaaacaaagaaataatgtaaactcccatcaacgttgttttctgcttctattttaatagaagctttggagacatgatttctggggcaggcttgactacgagtaatgtgtcttgtttggaaggtgtcattcacac

SEQ ID NO: 504 - DNA, 1731 bp, Homo sapiens
  misc_feature (315)..(1412): CDS
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatggtaagcatagttcagcgttgccaactcatgctatgctttctaatcattgtagatgtctgtgttctctaaataagtcagttttctgttggccaagagttacattatcatgaatgaatacagcttggccatggttccctcctccccctgtcaaaaagcaaaccacattaagtactctttacatttaatacttttgaattgaacagagagtcctttctttagatgcttattatggctaataattcggttagaacctaatatatttatgaaattcttagtgttctgtataaacaaaacagaaaaagatgatgagttttatctttattatctaagaaaaatttctcaggtactaccatgaattagagaaataaaaatatggtatgctaaatcatttagaattaatgctattttattcctgcttttactctcaag

SEQ ID NO: 505 - DNA, 188 bp, Homo sapiens
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggct

SEQ ID NO: 506 - DNA, 227 bp, Homo sapiens
gggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtg

SEQ ID NO: 507 - DNA, 125 bp, Homo sapiens
atacaggtagacctttcgtagagatgtacagtgaaatccccgaaattatacacatgactgaaggaagggagctcgtcattccctgccgggttacgtcacctaacatcactgttactttaaaaaag

SEQ ID NO: 508 - DNA, 163 bp, Homo sapiens
tttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaa

SEQ ID NO: 509 - DNA, 137 bp, Homo sapiens
ccaatacaatcatagatgtccaaataagcacaccacgcccagtcaaattacttagaggccatactcttgtcctcaattgtactgctaccactcccttgaacacgagagttcaaatgacctggagttaccctgatgaa

SEQ ID NO: 510 - DNA, 175 bp, Homo sapiens
aaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatg

SEQ ID NO: 511 - DNA, 429 bp, Homo sapiens
gtaagcatagttcagcgttgccaactcatgctatgctttctaatcattgtagatgtctgtgttctctaaataagtcagttttctgttggccaagagttacattatcatgaatgaatacagcttggccatggttccctcctccccctgtcaaaaagcaaaccacattaagtactctttacatttaatacttttgaattgaacagagagtcctttctttagatgcttattatggctaataattcggttagaacctaatatatttatgaaattcttagtgttctgtataaacaaaacagaaaaagatgatgagttttatctttattatctaagaaaaatttctcaggtactaccatgaattagagaaataaaaatatggtatgctaaatcatttagaattaatgctattttattcctgcttttactctcaag

SEQ ID NO: 512 - DNA, 170 bp, Homo sapiens
gttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatg

SEQ ID NO: 513 - DNA, 160 bp, Homo sapiens
tgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaag

SEQ ID NO: 514 - DNA, 954 bp, Homo sapiens
tatttggatataaggactgaggaacagattttttcctttattcagaagactcagacattgaaactcactgtctcatgcaaagctgccttctagtccagccagactacactgatctacaatttgcacctgagctcctttctctggccctataaagtttaaattttaattgtcaaataattttatttttaatgagaaaatgtttgaatttataatttaaaaatatatcccctgaaagagaagtactctagaaatgagataaattttaataaaactgatcataggatatgtttcaccttatttttaacttttcttctttagtgataaccattgtatttatcaaatatattttcaaaccacataacaacagttgaagagcagcttgcagcttatgtaaaatgtcatcagagaagccaactagtatttctgtaaatagtagtagtatttaatttatgttacccatctctgcggattaaaggaagtattctcaaggaaaaattcaattaaaggtgtagacagaattttgccaatagatctgtgttattcaacttaaagagtctcaaggcgagaagcaatctggtgtagagattaggagcataggcacggaggcagacacacctgagcataaattctgcccaggcctgtctgtggtcctttgcatctttgggtgaatcatctaatctctcggaacctcagttgtcctacctgtagaatagggtaatatacccatctcacagggttttggggaggattaaatgagacaattcctgtaaagtgccttgcatgctgcctggtgcattgtaaggcatacataaaggttcgcagaaacaaagaaataatgtaaactcccatcaacgttgttttctgcttctattttaatagaagctttggagacatgatttctggggcaggcttgactacgagtaatgtgtcttgtttggaaggtgtcattcacac

SEQ ID NO: 515 - DNA, 175 bp, Homo sapiens
atgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcac

SEQ ID NO: 516 - DNA, 134 bp, Homo sapiens
taaggagcactccatcactcttaatcttaccatcatgaatgtttccctgcaagattcaggcacctatgcctgcagagccaggaatgtatacacaggggaagaaatcctccagaagaaagaaattacaatcagag

SEQ ID NO: 517 - DNA, 4255 bp, Homo sapiens
gtgagcactgcaacaaaaaggctgttttctctcggatctccaaatttaaaagcacaaggaatgattgtaccacacaaagtaatgtaaaacattaaaggactcattaaaaagtaacagttgtctcatatcatcttgatttattgtcactgttgctaactttcaggctcggaggagatgctcctcccaaaatgagttcggagatgatagcagtaataatgagacccccgggccccagctctgggccccccattcaggccgagggggctgctccggggggccgacttggtgcacgtttggatttggaggatccctgcactgccttctctgtgtttgttgctcttgctgttttctcctgcctgataaacaacaacttgggatgatcctttccttccattttgatgccaacctctttttatttttaagtgttgaagctgcacaaactgaataatttaaacaaatgctggtttctgccaaagatggacacgaataagttaattttccagctcagaatgagtacagttgaatttgagactctgtcggacttctgcctggttttatttgggactatttcatctgctcttgatttgtaaatagcacctggatagcaagttataatgcttatttatttgaaaatgctttttttttttttacgttaagcacatttatcttgaactggagcttctaaaatgggccccaggggtgcaagatgttggtgtaattcagagatagtaaaggtttatcgcagtgtgaattataagagtccatccaaatcaacgtcccctccctcctctcatgcgatccaggtaattatgcagttagtgccacagtagactagcctagcaaagggtttgctccttgctgtctctgactgcaccacacagctattgatggcagctgaaagaaagtggatcatgccttaattttaaatattcctgtcctctggttattattttaaggaacttcatcatgttaaaatgacagcattcaaaggtgtaccacaatcaatttatcaaggaaataaaggctattgtaaccagagatttaatgcattcttctaaatgtaaatttaaaatttgccctttaaaaaagtccactttccccatatgcaaatgttaataggatttttatggggattaagaagcggcaaaactacagaagcagaattcaaagtaatttaaaaaatacacaccagttttaaatcaagagaagttgtaatctcttgttttaagcttgcgtttgagggaaaatgactttttcaccaatttaatatgcattgttctgttgtttttatttatgattgatcattatatgtgacttgcataaactatttaaaaaaaaaaactataatgaccaaaatagccatggctgagaaacacagtggctgggcagttcaataggaggtgacaatatgacaacttctcaagcttgggaactcaccagactgtttcctcctttaggtaacagattctgtcccacggctaaacttgtctttcacgtgggaattgcttttgtcaaacgtgaaagagtaaacaatagcatttccccagaatgccagttttatggagccccaaatgctctgaaaacaattagtaacctggaagttgtcagcccaaaggaaagaaaaatcaattgtatcttgaaattttacctatggctctttggcctggcttctttgttcattataagttagtgtgttccttcaggaaacaatgccttaataccatagaacatgggggccttaatagttgctaacattaaaaaagcaaacagaatgattgagggatccttatgaaaacaaaatggtgaattggacatgcagaacctaccatttccttcccctgtttgcaatttttgtggggaggggaggatgttagtatttacaaaagatgattttaagaacttccaagagatgagtttaagaattccatagagtattagttgttcactgtgtaattaatccttccggagagtcttttttttttttttttaaagaaacttttgggtgggttttgttttttattagttaccctaggggtatgttaccctggggtatgaagggaggtgaagataacggaggggggagaaaaaaaaaagaagaaaaaaggagcctaaaatggggaataattgaaatggaacagggggtgtgaggctggttcctcagtccccattccaaacggaggatagaagctgtgtatttatgtgacctggcagatctctggggccataacactgaaaagtgaaagaacctggtgggcagctatctttggctactgataaccagcagaaatgtctgttaattctgattttctcaatttgaagggatcagctacactgttaaattttggaaagccactacctacttccatcaagtaacttaggtttcgaaatatgggttcaacgcacctcccttattcaaaatgtcaaaatagattattataatgtataaagtaagaattgacaaaatatgattcttgggttgattggtcatttagaaactagccaaaagtgagacttttaatgtagaacatttttcagaaatgggtacaaagaaaaatgcatattactgtatatttcagagtgtttatgtgaaccttgtatttaattgagagtcccatgtacgttctgcagcctttttgctgcttctatcatctgaagtttgtgtagtacaaataaggcctttgggattcttaatgacatttatgttaaaatgttctcttctctttaaacaccgttttccaatccacctgtcagggagtccaaatcgtgtctgtgttgatgatgctatactttgtagctagaaaaacaattttagtgttgtgggctctgtattcagacttcctttttacaagaccgatgggcagtgatagattattttatcatatttaatgcatgggaaatagtgtgctgaggaagctattaaaagtataactcagtgaattgggtctgagttttaaatgagatatttcaaaattggcttgccactgtaaaagcgactaaataataatatgatactgttctttatgatcttgtcatgtttcactgatatgtttggggtcttcactatgtaaaaaatgtcaaaattgtaatgagcaagcatgtacaagtagtcgtaaatcaaaggttttaaacaggactgcattttcaattaggaaaagctgtttggcagatagcatccaatgcaaaaacagaaatatcgtaacgttctgcttagtgggcaagataagataggaaagacatgctcaaagaggcaaaagaatcattgctatcattcattctacactagtttgaagaagtttttgtacatcagagcacttccttcagcacacttttttgccttcagttttcattttttataaaatgagaagactaatgataaactgtagaaatcaaaatttattgagaaatctgtttctcctaacagatagtaaccctgccatgatatactacttcaacaatgttataaaagttatgtgataatatacattttaacctgggatttctaaattgctttaacaaatgctaatcctgagagttgccctgcaggactcaaaagggaaaggttttgggacgtggcagaaccctgcagggacatggaattaaggccattgcaatgtatcatctttgtagcattgtcatcactcctaagctgccttcacagttttagtacactaagatgaggaaatcgaaaatgggcagagaaagctcatactgtataattgaagacagtgacagagaacgtgtcagttatgccaaaactcttttgatttctgttccaggatttccaacaagaggggaaaggaatgacttgggagggtgggaaagacattaggagttgtttttattttttaccttggaagctttagctaccaatccagtaccctcctaactagaatgtatacacatcagcaggactgactgactacttcattagagatatactgtactcattgggggccttgggggtactgctgttcttatgtgggattttaatgttgtaatgtattgcatcttaatgtattgaattcattttgttgtactatattggttggcattttattaaaataaattgtattgtatcatatttgtatgttttaagagaaaataatataaaatacaatatttgtactattatatagtgcaaaaactacaaatctgtgcctctgcctcttgaattaattctttggttgcttgcatttgggaagggaatggagaaaggaaagaaccaataaagctttcaaagttcaagaaaaaatcc

SEQ ID NO: 518 - DNA, 147 bp, Homo sapiens
atcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctg

SEQ ID NO: 519 - DNA, 282 bp, Homo sapiens
gtaagagacttttttttcttccatttattatttctcatctttcatcagcccccctttcccttaacagtcccgtcacctgcttccagtatgtatagacctacttgctgatagagccccaaacactgggatctggttcatgctgatagcaatgtccagtgaggaatatttgggccagttcctatgcagaccatattcctaacccatagaaagatcctgcagaatctattcagctggaagtctttaaatagtgcattcagaaagaaatgagaagagccatgtaga

SEQ ID NO: 520 - DNA, 615 bp, Homo sapiens
gctctgcaaatacagcagtgaacaagaaaactgaaatctgaagaaccaaaaatctagagtaattaagtgatgcatgtatttacctgaaatacgcttcttcaagcaacaaccctgtgtgtcctgccttattcgctattatcgtgtcaattggtctaaaaatggaataaggcaaattaataaatgggcaatcagaaaaattctatggctcaatcatggtatcaaaatatctttaatacattggatagctgaaaagatacaccctttgtgctttaattttcctatgttcatgctgtgcatacaataagttctcaattgttgttagctgtatatacagaaaggaggaagagataaggggaaattagtaggggctccaaattagaactgagtaaagaagcaactgggaactcttagaagggactgatgtggtgcaaagtgttgaaagatgaaggtaatttaagacctatttactttgaagaggcaggtgaaaagagagtagacaagctgaagtgaatataatacagagagccagagataagagaggaaaatgcagtgtgaagggactaataccaagaagcaccacacaagagttcaaagtcagagatgaatcctgtttga

SEQ ID NO: 521 - DNA, 1473 bp, Homo sapiens
aactgtatacatcaacgtcaccatcgtcatcgtcatcatcaccattgtcatcatcatcatcatcgtcatcatcatcatcatcatagctatcatcattatcatcatcatcatcatcatcatcatagctaccatttattgaaaactattatgtgtcaacttcaaagaacttatcctttagttggagagccaagacaatcataacaataacaaatggccgggcatggtggctcacgcctgtaatcccagcactttgggaggccaaggcaggtggatcatttgaggtcaggagttcaagaccagcctgaccaagatggtgaaatgctgtctctattaaaaatacaaaattagccgggcatggtggctcatgcctgtaatgccagctactcgggaggctgagacaggagaatcacttgaacccaggaggcagaggttgcagggagccgagatcgtgtactgcactccagcctgggcaacaagagcgaaactccgtctcaaaaaacaaataaataaataaataaataaacagacaaaattcactttttattctattaaacttaacatacatgcattaattgcctactctgagcctgatcctttattatattctagagaaaatgaaaataagcaacacataatcctcacctttgaaaaacaaacataataggtacaaagtcagttcataaatgtgcaatgtgagtggtataaaataacatcagataaaaattagcacttctgatgactaatcaggggagatttcatggaggagatgtcatctgaattggactttgatgaataaaaaagagagttttgatgacgaatattagtttggccaaagtggatgaatataatgttctctaagtcaacaatacagatagtcaactgagcaacaaaacagaagttgctggtcagactagtaggcccatttaggagagcaacaagccacttttgtgtgtgggggggaacaggaggcaaacacatggcctgcatttatgtaatcaaataggtgaattcaaaagctctacagatttatttactcaatggtgaattggattaaaattatattccatgctcttccctgggcaatatggtgctcacacataaaatgccaagattgtccttcaccttaaggtataatgggaagaaataaagctatctacagagtcccttgaaaattacacctttaaaattgacagttggacatcttgaaaatttagaccacatcccatgaataaattaggccatcatggtcaaaaacttatccacatcctccattagcaaccaacataataagtaattcaaatcctcacactgagtttcatcgtcagatactttagaggacaccacacgtttctacaaaaacagcccagtgtaaagttttacttgtccttttggggctaatgctttagcaaacgcataaaaccaccagagtttgcattctaagctccaggaactgaggctttttgaaccttaaga

SEQ ID NO: 522 - DNA, 109 bp, Homo sapiens
ggagccgcgagacgggcgctcagggcgcggggccggcggcggcgaacgagaggacggactctggcggccgggtcgttggccgcggggagcgcgggcaccgggcgagcag

SEQ ID NO: 523 - DNA, 81 bp, Homo sapiens
gccgcgtcgcgctcaccatggtcagctactgggacaccggggtcctgctgtgcgcgctgctcagctgtctgcttctcacag

SEQ ID NO: 524 - DNA, 97 bp, Homo sapiens
gatctagttcaggttcaaaattaaaagatcctgaactgagtttaaaaggcacccagcacatcatgcaagcaggccagacactgcatctccaatgcag

SEQ ID NO: 525 - DNA, 118 bp, Homo sapiens
ataaagcattcatcactgtgaaacatcgaaaacagcaggtgcttgaaaccgtagctggcaagcggtcttaccggctctctatgaaagtgaaggcatttccctcgccggaagttgtatg

SEQ ID NO: 526 - DNA, 115 bp, Homo sapiens
gtgtgacttttgttccaataatgaagagtcctttatcctggatgctgacagcaacatgggaaacagaattgagagcatcactcagcgcatggcaataatagaaggaaagaataag

SEQ ID NO: 527 - DNA, 85 bp, Homo sapiens
cttccaccagctaacagttctttcatgttgccacctacaagcttctcttccaactacttccatttccttccgtgactctaaacgg

SEQ ID NO: 528 - DNA, 109 bp, Homo sapiens
atggctagcaccttggttgtggctgactctagaatttctggaatctacatttgcatagcttccaataaagttgggactgtgggaagaaacataagcttttatatcacag

SEQ ID NO: 529 - DNA, 65 bp, Homo sapiens
aattgtcaaactttgagtgccttcatccttgctctcaggaatagaattctacctcatcggatctc

SEQ ID NO: 530 - protein, 1338 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLLIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 531 - protein, 567 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITELSNFECLHPCSQE

SEQ ID NO: 532 - protein, 541 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKLPPANSSFMLPPTSFSSNYFHFLP

SEQ ID NO: 533 - protein, 733 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPELYTSTSPSSSSSSPLSSSSSSSSSSSS

SEQ ID NO: 534 - protein, 718 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGSANTAVNKKTEI

SEQ ID NO: 535 - protein, 736 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGKRLFFLPFIISHLSSAPLSLNSPVTCFQYV

SEQ ID NO: 536 - protein, 547 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKYLDIRTEEQIFSFIQKTQTLKLTVSCKAAF

SEQ ID NO: 537 - protein, 365 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYGKHSSALPTHAMLSNHCRCLCSLNKSVFCWPRVTLS

SEQ ID NO: 538 - DNA, 2693 bp, Homo sapiens
  misc_feature (303)..(2339): CDS
actgagtcccgggaccccgggagagcggtcagtgtgtggtcgctgcgtttcctctgcctgcgccgggcatcacttgcgcgccgcagaaagtccgtctggcagcctggatatcctctcctaccggcacccgcagacgcccctgcagccgcggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtttgcctagtgtttctcttgatctgcccaggctcagcatacaaaaagacatacttacaattaaggctaatacaactcttcaaattacttgcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaagattacagatctccatttattgcttctgttagtgaccaacatggagtcgtgtacattactgagaacaaaaacaaaactgtggtgattccatgtctcgggtccatttcaaatctcaacgtgtcactttgtgcaagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtagggtataggatttatgatgtggttctgagtccgtctcatggaattgaactatctgttggagaaaagcttgtcttaaattgtacagcaagaactgaactaaatgtggggattgacttcaactgggaatacccttcttcgaagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatgaaaaaccttttgttgcttttggaagtggcatggaatctctggtggaagccacggtgggggagcgtgtcagaatccctgcgaagtaccttggttacccacccccagaaataaaatggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatgtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccagccaagctgtctcagtgacaaacccatacccttgtgaagaatggagaagtgtggaggacttccagggaggaaataaaattgaagttaataaaaatcaatttgctctaattgaaggaaaaaacaaaactgtaagtacccttgttatccaagcggcaaatgtgtcagctttgtacaaatgtgaagcggtcaacaaagtcgggagaggagagagggtgatctccttccacgtgaccaggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctaggtagggagacaattctggatcattgtgcagaggcagttggaatgccttaaatgtagtgcaattcaggtgctatgcaaagattactgtcctctaggagattatgttgtaaactggtgcacacttcttcaccgaaagtccttgaggaagaaagaagctaataataatgaaatgatatatcgaaaggagaaaataacaaaacctgatgatggagtaattcactagtatatgcaagggatattagcttgaaccagggaaacttctgccttatcttgggcatccatttatttaaatagacaaatatttgtggaatgcctgctatgagctaggagagtgtcagaaattcacagtggtaaacatgaaggaaaggaggagaacataggcaaccactgggaagtcacagcaca

SEQ ID NO: 539 - DNA, 2311 bp, Homo sapiens
  misc_feature (303)..(1712): CDS
actgagtcccgggaccccgggagagcggtcagtgtgtggtcgctgcgtttcctctgcctgcgccgggcatcacttgcgcgccgcagaaagtccgtctggcagcctggatatcctctcctaccggcacccgcagacgcccctgcagccgcggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtttgcctagtgtttctcttgatctgcccaggctcagcatacaaaaagacatacttacaattaaggctaatacaactcttcaaattacttgcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaagattacagatctccatttattgcttctgttagtgaccaacatggagtcgtgtacattactgagaacaaaaacaaaactgtggtgattccatgtctcgggtccatttcaaatctcaacgtgtcactttgtgcaagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtagggtataggatttatgatgtggttctgagtccgtctcatggaattgaactatctgttggagaaaagcttgtcttaaattgtacagcaagaactgaactaaatgtggggattgacttcaactgggaatacccttcttcgaagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatgaaaaaccttttgttgcttttggaagtggcatggaatctctggtggaagccacggtgggggagcgtgtcagaatccctgcgaagtaccttggttacccacccccagaaataaaatggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatggtgagtccattcaattttcctctctgcccaagatttattatgatacattgtcttccaaatcagccaaaccaccgttcctctgcctcctgctgcttcactcatatcatggctgggcctgcgtacaaaagtcatctggcgtggtgaagctgaagtgaaacgtaggaccatgtgctctggccatgtttgtttaagaggccgtgtaaatgagctttgtggtggacaaatgcaagattaaagtagtgataccctcgatagctaaatgttgtgaaataagaatgcccacagggacagttgtcaagctaagttatactaccatgttcccctctcatggaattgcccacctggtacacagatgtgtaagacccttctccttagattttgtgcaaagcttctagtttgatgttgtagttgatgtatcagagatgtgcaggcacgttccaactctgaaggcttttgaagttgacactgttggcttggttgggagcttttcttttttcctttttgacaggagttcaggatctgattttgagtctgtaaaggaaagatagtaagtttttgatgtaaagataatttgaactttgttttctgaaactgaaaggtacaaataagtgtttggaatggagtggggagaagggtgccatggtcaagtgagtgtgagaggtgctaaggtgatgtgtagatgtgtaacaggtttctttattgcaggacttcgcagaaccttttatatgctaatgtatattggtattctccagga

SEQ ID NO: 540 - DNA, 369 bp, Homo sapiens
actgagtcccgggaccccgggagagcggtcagtgtgtggtcgctgcgtttcctctgcctgcgccgggcatcacttgcgcgccgcagaaagtccgtctggcagcctggatatcctctcctaccggcacccgcagacgcccctgcagccgcggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgg

SEQ ID NO: 541 - DNA, 197 bp, Homo sapiens
gggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaag

SEQ ID NO: 542 - DNA, 131 bp, Homo sapiens
attacagatctccatttattgcttctgttagtgaccaacatggagtcgtgtacattactgagaacaaaaacaaaactgtggtgattccatgtctcgggtccatttcaaatctcaacgtgtcactttgtgca

SEQ ID NO: 543 - DNA, 169 bp, Homo sapiens
agatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtag

SEQ ID NO: 544 - DNA, 140 bp, Homo sapiens
ggtataggatttatgatgtggttctgagtccgtctcatggaattgaactatctgttggagaaaagcttgtcttaaattgtacagcaagaactgaactaaatgtggggattgacttcaactgggaatacccttcttcgaag

SEQ ID NO: 545 - DNA, 178 bp, Homo sapiens
catcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatg

SEQ ID NO: 546 - DNA, 164 bp, Homo sapiens
gtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatg

SEQ ID NO: 547 - DNA, 754 bp, Homo sapiens
gtgagtccattcaattttcctctctgcccaagatttattatgatacattgtcttccaaatcagccaaaccaccgttcctctgcctcctgctgcttcactcatatcatggctgggcctgcgtacaaaagtcatctggcgtggtgaagctgaagtgaaacgtaggaccatgtgctctggccatgtttgtttaagaggccgtgtaaatgagctttgtggtggacaaatgcaagattaaagtagtgataccctcgatagctaaatgttgtgaaataagaatgcccacagggacagttgtcaagctaagttatactaccatgttcccctctcatggaattgcccacctggtacacagatgtgtaagacccttctccttagattttgtgcaaagcttctagtttgatgttgtagttgatgtatcagagatgtgcaggcacgttccaactctgaaggcttttgaagttgacactgttggcttggttgggagcttttcttttttcctttttgacaggagttcaggatctgattttgagtctgtaaaggaaagatagtaagtttttgatgtaaagataatttgaactttgttttctgaaactgaaaggtacaaataagtgtttggaatggagtggggagaagggtgccatggtcaagtgagtgtgagaggtgctaaggtgatgtgtagatgtgtaacaggtttctttattgcaggacttcgcagaaccttttatatgctaatgtatattggtattctccagga

SEQ ID NO: 548 - DNA, 157 bp, Homo sapiens
tcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccag

SEQ ID NO: 549 - DNA, 124 bp, Homo sapiens
ccaagctgtctcagtgacaaacccatacccttgtgaagaatggagaagtgtggaggacttccagggaggaaataaaattgaagttaataaaaatcaatttgctctaattgaaggaaaaaacaaa

SEQ ID NO: 550 - DNA, 342 bp, Homo sapiens
ggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctag

SEQ ID NO: 551 - DNA, 404 bp, Homo sapiens
gtagggagacaattctggatcattgtgcagaggcagttggaatgccttaaatgtagtgcaattcaggtgctatgcaaagattactgtcctctaggagattatgttgtaaactggtgcacacttcttcaccgaaagtccttgaggaagaaagaagctaataataatgaaatgatatatcgaaaggagaaaataacaaaacctgatgatggagtaattcactagtatatgcaagggatattagcttgaaccagggaaacttctgccttatcttgggcatccatttatttaaatagacaaatatttgtggaatgcctgctatgagctaggagagtgtcagaaattcacagtggtaaacatgaaggaaaggaggagaacataggcaaccactgggaagtcacagcaca

SEQ ID NO: 552 - DNA, 94 bp, Homo sapiens
gtttgcctagtgtttctcttgatctgcccaggctcagcatacaaaaagacatacttacaattaaggctaatacaactcttcaaattacttgcag

SEQ ID NO: 553 - DNA, 115 bp, Homo sapiens
aaaaaccttttgttgcttttggaagtggcatggaatctctggtggaagccacggtgggggagcgtgtcagaatccctgcgaagtaccttggttacccacccccagaaataaaatg

SEQ ID NO: 554 - DNA, 109 bp, Homo sapiens
actgtaagtacccttgttatccaagcggcaaatgtgtcagctttgtacaaatgtgaagcggtcaacaaagtcgggagaggagagagggtgatctccttccacgtgacca

SEQ ID NO: 555 - protein, 1356 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 556 - protein, 678 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLGRETILDHCAEAVGMP

SEQ ID NO: 557 - protein, 469 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYGESIQFSSLPKIYYDTLSSKSAKPPFLCLLLLHSYHGWACVQKSSGVVKLK

SEQ ID NO: 558 - DNA, 2087 bp, Homo sapiens
  misc_feature (420)..(944): CDS
gatggttaaggatgcccagaagattgaataaaattgggatttaggaggacccttgtactccaggaaattctccaagtctccacttagttatccagatcctcaaagtgaacatgaagcttcagtttcaaattgaatacattttccatccatggattggcttgttttgttcagttgagtgcttgaggttgtcttttcgacgtaacagctaaacccacggcttcctttctcgtaaaaccaaaacaaaaaggctttctattcaagtgccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgtttt

SEQ ID NO: 559 - DNA, 455 bp, Homo sapiens
gatggttaaggatgcccagaagattgaataaaattgggatttaggaggacccttgtactccaggaaattctccaagtctccacttagttatccagatcctcaaagtgaacatgaagcttcagtttcaaattgaatacattttccatccatggattggcttgttttgttcagttgagtgcttgaggttgtcttttcgacgtaacagctaaacccacggcttcctttctcgtaaaaccaaaacaaaaaggctttctattcaagtgccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcag

SEQ ID NO: 560 - DNA, 348 bp, Homo sapiens
caatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattg

SEQ ID NO: 561 - DNA, 620 bp, Homo sapiens
ctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatac

SEQ ID NO: 562 - DNA, 591 bp, Homo sapiens
atatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgtttt

SEQ ID NO: 563 - DNA, 73 bp, Homo sapiens
ctgaacctggctaccaggacctggccctgcactctcctgttttttcttctcttcatccctgtcttctgcaaag

SEQ ID NO: 564 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 565 - protein, 174 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIAKEKKPSYNRGLCENAPNRARM

SEQ ID NO: 566 - DNA, 2313 bp, Homo sapiens
  misc_feature (282)..(938): CDS
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaaagtcctgctctgtcgcccaggctggaatgcagtggcgcgatctcggctcactgcaacctctgcctcccagattcaagcaattctcctgcttcagcctcccaagtagctgggattacagctgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctct

SEQ ID NO: 567 - DNA, 3262 bp, Homo sapiens
  misc_feature (282)..(938): CDS
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaaagtcctgctctgtcgcccaggctggaatgcagtggcgcgatctcggctcactgcaacctctgcctcccagattcaagcaattctcctgcttcagcctcccaagtagctgggattacaggcacgtgccaccatgcctggctaatttttgtatttttagtagagatggggtttcaccatcttggtcaggctggtctcaaactcctggtgatccacctgcctctgcctcccaaagtgctgggattacagccgtgagccactgcacccagccggcttcatctcttcttgaaatcacttttataccattctatgtggttctcaccatgagcttgagtggtgggctaaagtgcctctccctgctttcagcttcctgctgggaactcactctctcaagttccttccagcaccaccccatagagttcccatcactccacactgtccagtgacaactcccaacatggaagatctgctagttctacagggtgctctctggctgccccagtaacatgtgtttttaaatttttcacatgcatgtttgaccccgactccccgaagtcaggtactgtaactagcagtgtcatttaagaaaaagccctttaacctctctttgccaaaggattcttatcagcaaaacagtgatgaaacaacaatcccataacagctagctggctaccttctcaagcacttattaaatgaggcataatgattttgcttaatcctcaatcctgagaggtgggcgatccctgtggtgatgaggaaaccgaggcttgggggttaatggcttgcctagattcacactgctagccaaggaatgaactggaatttacaccctgaccctgactgcttttcacattttctacacagccttttcaagatccctgccaattctaaaattaaatgattctatgattaactgtgtttcattcttctgcatcagttcccaaaacaaattatatcaagagacagcaaaaatatttgtaaagaaaggatgtccaacaatctgtgtggttgtttttctgtgttcctccaatggtagggcctctgttcaccagtgccgtctcttcttttagctgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctct

SEQ ID NO: 568 - DNA, 3403 bp, Homo sapiens
  misc_feature (282)..(938): CDS
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaaagtcctgctctgtcgcccaggctggaatgcagtggcgcgatctcggctcactgcaacctctgcctcccagattcaagcaattctcctgcttcagcctcccaagtagctgggattacaggcacgtgccaccatgcctggctaatttttgtatttttagtagagatggggtttcaccatcttggtcaggctggtctcaaactcctggtgatccacctgcctctgcctcccaaagtgctgggattacagccgtgagccactgcacccagccggcttcatctcttcttgaaatcacttttataccattctatgtggttctcaccatgagcttgagtggtgggctaaagtgcctctccctgctttcagcttcctgctgggaactcactctctcaagttccttccagcaccaccccatagagttcccatcactccacactgtccagtgacaactcccaacatggaagatctgctagttctacagggtgctctctggctgccccagtaacatgtgtttttaaatttttcacatgcatgtttgaccccgactccccgaagtcaggtactgtaactagcagtgtcatttaagaaaaagccctttaacctctctttgccaaaggattcttatcagcaaaacagtgatgaaacaacaatcccataacagctagctggctaccttctcaagcacttattaaatgaggcataatgattttgcttaatcctcaatcctgagaggtgggcgatccctgtggtgatgaggaaaccgaggcttgggggttaatggcttgcctagattcacactgctagccaaggaatgaactggaatttacaccctgaccctgactgcttttcacattttctacacagccttttcaagatccctgccaattctaaaattaaatgattctatgattaactgtgtttcattcttctgcatcagttcccaaaacaaattatatcaagagacagcaaaaatatttgtaaagaaaggatgtccaacaatctgtgtggttgtttttctgtgttcctccaatggtagggcctctgttcaccagtgccgtctcttcttttagctgtaagaaaagcctggagtgcacgaagttgtgcctaccccagattgagaatgttaagggcactgaggactcaggtgaggagaggtgacctggtgcccatgctcacctgccctctccctcttcttgcccccacccgtccatccatcccacccatccatctatccctgcggcccccctctgcccgctcctctgaccaacacctgctttgtctgcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctct

SEQ ID NO: 569 - DNA, 3481 bp, Homo sapiens
  misc_feature (282)..(1157): CDS
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgtgagcgcagctctcctgaggccaagccctctccccaccccaggggttggccccttccccatgcggtggcacttcctttccttccccctcctgtattctgtgggtctgacaaccaactcctctctggccgcccccaccctgtccctcgtcacttcctctgtcctgtggggtgggggtgcaggcgcttctcctttagctgtgccgcacttctccctacaggccaggagaaacagaacaccgtgtgcacctgccatgcaggtttctttctaagagaaaacgagtgtgtctcctgtagtaaagtcctgctctgtcgcccaggctggaatgcagtggcgcgatctcggctcactgcaacctctgcctcccagattcaagcaattctcctgcttcagcctcccaagtagctgggattacaggcacgtgccaccatgcctggctaatttttgtatttttagtagagatggggtttcaccatcttggtcaggctggtctcaaactcctggtgatccacctgcctctgcctcccaaagtgctgggattacagccgtgagccactgcacccagccggcttcatctcttcttgaaatcacttttataccattctatgtggttctcaccatgagcttgagtggtgggctaaagtgcctctccctgctttcagcttcctgctgggaactcactctctcaagttccttccagcaccaccccatagagttcccatcactccacactgtccagtgacaactcccaacatggaagatctgctagttctacagggtgctctctggctgccccagtaacatgtgtttttaaatttttcacatgcatgtttgaccccgactccccgaagtcaggtactgtaactagcagtgtcatttaagaaaaagccctttaacctctctttgccaaaggattcttatcagcaaaacagtgatgaaacaacaatcccataacagctagctggctaccttctcaagcacttattaaatgaggcataatgattttgcttaatcctcaatcctgagaggtgggcgatccctgtggtgatgaggaaaccgaggcttgggggttaatggcttgcctagattcacactgctagccaaggaatgaactggaatttacaccctgaccctgactgcttttcacattttctacacagccttttcaagatccctgccaattctaaaattaaatgattctatgattaactgtgtttcattcttctgcatcagttcccaaaacaaattatatcaagagacagcaaaaatatttgtaaagaaaggatgtccaacaatctgtgtggttgtttttctgtgttcctccaatggtagggcctctgttcaccagtgccgtctcttcttttagctgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctct

SEQ ID NO: 570 - DNA, 2317 bp, Homo sapiens
  misc_feature (282)..(938): CDS
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaaagtcctgctctgtcgcccaggctggaatgcagtggcgcgatctcggctcactgcaacctctgcctcccagattcaagcaattctcctgcttcagcctcccaagtagctgggattacaggcacctgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctct

SEQ ID NO: 571 - DNA, 2121 bp, Homo sapiens
  misc_feature (282)..(968): CDS
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaagcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctct

SEQ ID NO: 572 - DNA, 2239 bp, Homo sapiens
  misc_feature (282)..(938): CDS
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaaagtcctgctctgtcgcccaggctggaatgcagtggcgcgatctcggctcactgcaacctctgcctcccagattcaagcaattctcctgcttcagcctcccaagtagctgggattacaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctct

SEQ ID NO: 573 - DNA, 2042 bp, Homo sapiens
  misc_feature (282)..(1496): CDS
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctct

SEQ ID NO: 574 - DNA, 2276 bp, Homo sapiens
  misc_feature (282)..(938): CDS
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaaagtcctgctctgtcgcccaggctggaatgcagtggcgcgatctcggctcactgcaacctctgcctcccagattcaagcaattctcctgcttcagcctcccaagtagctgggattacagctgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcatcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctct

SEQ ID NO: 575 - DNA, 1885 bp, Homo sapiens
  misc_feature (282)..(1025): CDS
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctct

SEQ ID NO: 576 - DNA, 2016 bp, Homo sapiens
  misc_feature (282)..(1010): CDS
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaaagtcctgctctgtcgcccaggctggaatgcagtggcgcgatctcggctcactgcaacctctgcctcccagattcaagcaattctcctgcttcagcctcccaagcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctct

SEQ ID NO: 577 - DNA, 1412 bp, Homo sapiens
  misc_feature (282)..(941): CDS
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctctgctcttggagacagtggtctgtcgggatgggaggtgggggcagaggcccagatcctgaggggtgagatgggaaaagccctgcactagggccaggtagcccatcaccatcacgccaagtgacagaggagtagcaggttcttgttctgaacaccgtcatctgttgcccaagctggagtgcgctcactgcagcctccaacccttgggctcatggggtcctcccgcctcagcctccggacacaggca

SEQ ID NO: 578 - DNA, 1845 bp, Homo sapiens
  misc_feature (282)..(836): CDS
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaagtgagtatctctgagagctgctgggcactggatggtggcatgggttgggacgggtgactggtgggaaccattagctgggcaacagatgccaggatgccccagagtgctcagggtcctactggctgagtaggagacacttcgttaagacaccaggcagtccttccccttgctcttcaaatctgaagaagtctttgaggatggaagatcatgccccaagggctggcagcccttccaactcagatatgtagattcttggatctacgatagctcattggttctaggacatacactcttatagctctgaaatcaaacctcctataactggtgactcatcatggttgaattggcagctctgtttgcgtctgggtagtaatgtaaagaaaagtgccttttattcttgatggcgtcttaggtttgatgcaatatggtatttcctcattagtcactgtccaggcctccttactcctggctccacagaggctgttcttgtcactcacttgcaaagaataaactctgagggctctcagagtttgaaccccagcatagccacttactggctatgtgacgttgggcaagtttcttaacatctctgagcctgacttttcttttggtgttttttttttttttttttttttgagacagggtttcactctgtcacccaggctggagtgcagtggtgcaaccgtggctcagcctccacctccagggctcaagccatcctcttgccttagcctcctgagtagctgggattagaggcacacaccactacacccagctaatgttttactttttgtagagacagggtcctactatattgcccaggctggcctcggactcctgggctcaagcgatcttccgcctcagcctcccaaagtgctaggattacgggcatgagccaccacgcctggcctgggccttagatttcttatatttaaagtaagcataatgacattcatttggtgaatttgtgagaaccaaaaacaaagaaacaaacaaaacctacaacacgtctg

SEQ ID NO: 579 - DNA, 136 bp, Homo sapiens
atcactgggaccaggccgtgatctctatgcccgagtctcaaccctcaactgtcaccccaaggcacttgggacgtcctggacagaccgagtcccgggaagccccagcactgccgctgccacactgccctgagcccaa

SEQ ID NO: 580 - DNA, 219 bp, Homo sapiens
gtgagcgcagctctcctgaggccaagccctctccccaccccaggggttggccccttccccatgcggtggcacttcctttccttccccctcctgtattctgtgggtctgacaaccaactcctctctggccgcccccaccctgtccctcgtcacttcctctgtcctgtggggtgggggtgcaggcgcttctcctttagctgtgccgcacttctccctacag

SEQ ID NO: 581 - DNA, 1013 bp, Homo sapiens
gtgagtatctctgagagctgctgggcactggatggtggcatgggttgggacgggtgactggtgggaaccattagctgggcaacagatgccaggatgccccagagtgctcagggtcctactggctgagtaggagacacttcgttaagacaccaggcagtccttccccttgctcttcaaatctgaagaagtctttgaggatggaagatcatgccccaagggctggcagcccttccaactcagatatgtagattcttggatctacgatagctcattggttctaggacatacactcttatagctctgaaatcaaacctcctataactggtgactcatcatggttgaattggcagctctgtttgcgtctgggtagtaatgtaaagaaaagtgccttttattcttgatggcgtcttaggtttgatgcaatatggtatttcctcattagtcactgtccaggcctccttactcctggctccacagaggctgttcttgtcactcacttgcaaagaataaactctgagggctctcagagtttgaaccccagcatagccacttactggctatgtgacgttgggcaagtttcttaacatctctgagcctgacttttcttttggtgttttttttttttttttttttttgagacagggtttcactctgtcacccaggctggagtgcagtggtgcaaccgtggctcagcctccacctccagggctcaagccatcctcttgccttagcctcctgagtagctgggattagaggcacacaccactacacccagctaatgttttactttttgtagagacagggtcctactatattgcccaggctggcctcggactcctgggctcaagcgatcttccgcctcagcctcccaaagtgctaggattacgggcatgagccaccacgcctggcctgggccttagatttcttatatttaaagtaagcataatgacattcatttggtgaatttgtgagaaccaaaaacaaagaaacaaacaaaacctacaacacgtctg

SEQ ID NO: 582 - DNA, 945 bp, Homo sapiens
gtgccaccatgcctggctaatttttgtatttttagtagagatggggtttcaccatcttggtcaggctggtctcaaactcctggtgatccacctgcctctgcctcccaaagtgctgggattacagccgtgagccactgcacccagccggcttcatctcttcttgaaatcacttttataccattctatgtggttctcaccatgagcttgagtggtgggctaaagtgcctctccctgctttcagcttcctgctgggaactcactctctcaagttccttccagcaccaccccatagagttcccatcactccacactgtccagtgacaactcccaacatggaagatctgctagttctacagggtgctctctggctgccccagtaacatgtgtttttaaatttttcacatgcatgtttgaccccgactccccgaagtcaggtactgtaactagcagtgtcatttaagaaaaagccctttaacctctctttgccaaaggattcttatcagcaaaacagtgatgaaacaacaatcccataacagctagctggctaccttctcaagcacttattaaatgaggcataatgattttgcttaatcctcaatcctgagaggtgggcgatccctgtggtgatgaggaaaccgaggcttgggggttaatggcttgcctagattcacactgctagccaaggaatgaactggaatttacaccctgaccctgactgcttttcacattttctacacagccttttcaagatccctgccaattctaaaattaaatgattctatgattaactgtgtttcattcttctgcatcagttcccaaaacaaattatatcaagagacagcaaaaatatttgtaaagaaaggatgtccaacaatctgtgtggttgtttttctgtgttcctccaatggtagggcctctgttcaccagtgccgtctcttcttttag

SEQ ID NO: 583 - DNA, 141 bp, Homo sapiens
gtgaggagaggtgacctggtgcccatgctcacctgccctctccctcttcttgcccccacccgtccatccatcccacccatccatctatccctgcggcccccctctgcccgctcctctgaccaacacctgctttgtctgcag

SEQ ID NO: 584 - DNA, 265 bp, Homo sapiens
atcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctg

SEQ ID NO: 585 - DNA, 313 bp, Homo sapiens
ggaacaatggggccttcagctggagctgtggacttttgtacatacactaaaattctgaagttaaagctctgctcttggagacagtggtctgtcgggatgggaggtgggggcagaggcccagatcctgaggggtgagatgggaaaagccctgcactagggccaggtagcccatcaccatcacgccaagtgacagaggagtagcaggttcttgttctgaacaccgtcatctgttgcccaagctggagtgcgctcactgcagcctccaacccttgggctcatggggtcctcccgcctcagcctccggacacaggca

SEQ ID NO: 586 - DNA, 114 bp, Homo sapiens
gctgttgcaacactgcctcactcttcccctcccaccttctctcccctcctctctgctttaattttctcagaattctctggactgaggctccagttctggcctttggggttcaag

SEQ ID NO: 587 - DNA, 46 bp, Homo sapiens
atgggggagtgagaggccatagctgtctggcatgggcctctccacc

SEQ ID NO: 588 - DNA, 4 bp, Homo sapiens
gtgc

SEQ ID NO: 589 - DNA, 20 bp, Homo sapiens
ctgacctgctgctgccactg

SEQ ID NO: 590 - DNA, 37 bp, Homo sapiens
gtgctcctggagctgttggtgggaatatacccctcag

SEQ ID NO: 591 - DNA, 23 bp, Homo sapiens
gggttattggactggtccctcac

SEQ ID NO: 592 - DNA, 22 bp, Homo sapiens
ctaggggacagggagaagagag

SEQ ID NO: 593 - DNA, 72 bp, Homo sapiens
atagtgtgtgtccccaaggaaaatatatccaccctcaaaataattcgatttgctgtaccaagtgccacaaag

SEQ ID NO: 594 - DNA, 52 bp, Homo sapiens
gaacctacttgtacaatgactgtccaggcccggggcaggatacggactgcag

SEQ ID NO: 595 - DNA, 12 bp, Homo sapiens
ggagtgtgagag

SEQ ID NO: 596 - DNA, 28 bp, Homo sapiens
cggctccttcaccgcttcagaaaaccac

SEQ ID NO: 597 - DNA, 8 bp, Homo sapiens
ctcagaca

SEQ ID NO: 598 - DNA, 29 bp, Homo sapiens
ctgcctcagctgctccaaatgccgaaagg

SEQ ID NO: 599 - DNA, 46 bp, Homo sapiens
aaatgggtcaggtggagatctcttcttgcacagtggaccgggacac

SEQ ID NO: 600 - DNA, 104 bp, Homo sapiens
cgtgtgtggctgcaggaagaaccagtaccggcattattggagtgaaaaccttttccagtgcttcaattgcagcctctgcctcaatgggaccgtgcacctctcct

SEQ ID NO: 601 - DNA, 79 bp, Homo sapiens
gccaggagaaacagaacaccgtgtgcacctgccatgcaggtttctttctaagagaaaacgagtgtgtctcctgtagtaa

SEQ ID NO: 602 - DNA, 102 bp, Homo sapiens
agtcctgctctgtcgcccaggctggaatgcagtggcgcgatctcggctcactgcaacctctgcctcccagattcaagcaattctcctgcttcagcctcccaa

SEQ ID NO: 603 - DNA, 16 bp, Homo sapiens
gtagctgggattacag

SEQ ID NO: 604 - DNA, 4 bp, Homo sapiens
gcac

SEQ ID NO: 605 - DNA, 74 bp, Homo sapiens
ctgtaagaaaagcctggagtgcacgaagttgtgcctaccccagattgagaatgttaagggcactgaggactcag

SEQ ID NO: 606 - DNA, 23 bp, Homo sapiens
gcaccacagtgctgttgcccctg

SEQ ID NO: 607 - DNA, 21 bp, Homo sapiens
gtcattttctttggtctttgc

SEQ ID NO: 608 - DNA, 70 bp, Homo sapiens
cttttatccctcctcttcattggtttaatgtatcgctaccaacggtggaagtccaagctctactccattg

SEQ ID NO: 609 - DNA, 29 bp, Homo sapiens
tttgtgggaaatcgacacctgaaaaagag

SEQ ID NO: 610 - DNA, 33 bp, Homo sapiens
ggggagcttgaaggaactactactaagcccctg

SEQ ID NO: 611 - DNA, 19 bp, Homo sapiens
gccccaaacccaagcttca

SEQ ID NO: 612 - DNA, 12 bp, Homo sapiens
gtcccactccag

SEQ ID NO: 613 - DNA, 25 bp, Homo sapiens
gcttcacccccaccctgggcttcag

SEQ ID NO: 614 - DNA, 12 bp, Homo sapiens
tcccgtgcccag

SEQ ID NO: 615 - DNA, 6 bp, Homo sapiens
ttccac

SEQ ID NO: 616 - DNA, 54 bp, Homo sapiens
cttcacctccagctccacctatacccccggtgactgtcccaactttgcggctcc

SEQ ID NO: 617 - DNA, 6 bp, Homo sapiens
ccgcag

SEQ ID NO: 618 - DNA, 33 bp, Homo sapiens
agaggtggcaccaccctatcagggggctgaccc

SEQ ID NO: 619 - DNA, 66 bp, Homo sapiens
catccttgcgacagccctcgcctccgaccccatccccaacccccttcagaagtgggaggacagcgc

SEQ ID NO: 620 - DNA, 23 bp, Homo sapiens
ccacaagccacagagcctagaca

SEQ ID NO: 621 - DNA, 44 bp, Homo sapiens
ctgatgaccccgcgacgctgtacgccgtggtggagaacgtgccc

SEQ ID NO: 622 - DNA, 94 bp, Homo sapiens
ccgttgcgctggaaggaattcgtgcggcgcctagggctgagcgaccacgagatcgatcggctggagctgcagaacgggcgctgcctgcgcgagg

SEQ ID NO: 623 - DNA, 7 bp, Homo sapiens
cgcaata

SEQ ID NO: 624 - DNA, 73 bp, Homo sapiens
cagcatgctggcgacctggaggcggcgcacgccgcggcgcgaggccacgctggagctgctgggacgcgtgctc

SEQ ID NO: 625 - DNA, 6 bp, Homo sapiens
cgcgac

SEQ ID NO: 626 - DNA, 56 bp, Homo sapiens
atggacctgctgggctgcctggaggacatcgaggaggcgctttgcggccccgccgc

SEQ ID NO: 627 - DNA, 72 bp, Homo sapiens
cctcccgcccgcgcccagtcttctcagatgaggctgcgcccctgcgggcagctctaaggaccgtcctgcgag

SEQ ID NO: 628 - DNA, 13 bp, Homo sapiens
gttcgtccctgag

SEQ ID NO: 629 - DNA, 69 bp, Homo sapiens
cctttttcacagtgcataagcagttttttttgtttttgttttgttttgttttgtttttaaatcaatcat

SEQ ID NO: 630 - DNA, 89 bp, Homo sapiens
agttacactaatagaaacttggcactcctgtgccctctgcctggacaagcacatagcaagctgaactgtcctaaggcaggggcgagcac

SEQ ID NO: 631 - protein, 455 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 632 - protein, 291 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCERSSPEAKPSPHPRGWPLPHAVALPFLPPPVFCGSDNQLLSGRPHPVPRHFLCPVGWGCRRFSFSCAALLPTGQEKQNTVCTCHAGFFLRENECVSCSKVLLCRPGWNAVARSRLTATSASQIQAILLLQPPK

SEQ ID NO: 633 - protein, 228 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSKHHSAVAPGHFLWSLPFIPPLHWFNVSLPTVEVQALLHCLWEIDT

SEQ ID NO: 634 - protein, 404 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 635 - protein, 218 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSKVLLCRPGWNAVARSRLTATSASQIQAILLLQPPK

SEQ ID NO: 636 - protein, 247 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSERWHHPIRGLTPSLRQPSPPTPSPTPFRSGRTAPTSHRA

SEQ ID NO: 637 - protein, 242 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSKVLLCRPGWNAVARSRLTATSASQIQAILLLQPPKLHPHPGLQSRAQFHLHLQLHLYPR

SEQ ID NO: 638 - protein, 219 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVRP

SEQ ID NO: 639 - protein, 184 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSK

SEQ ID NO: 640 - protein, 217 aa, Homo sapiens
MATGSRTSLLLAFGLLCLPWLQEGSAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 641 - protein, 49 aa, Homo sapiens
VRVAPGVTNPGTPLASRAGGEKYCCPLFSKAGRRQPPDWADPQADLQQV

SEQ ID NO: 642 - protein, 106 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKVIRILKCGTC

SEQ ID NO: 643 - protein, 25 aa, Homo sapiens
LHFQPWQLWLWAQESPSSCLVFPAS

SEQ ID NO: 644 - protein, 2386 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTQGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 645 - protein, 19 aa, Homo sapiens
GNRKISCYPESDTSNKSGD

SEQ ID NO: 646 - protein, 2386 aa, Homo sapiens [sequence omitted]

SEQ ID NO: 647 - protein, 291 aa, Homo sapiens
MQRARPTLWAAALTLLVLLRGPPVARAGASSGGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 648 - protein, 417 aa, Homo sapiens
MEKERETLQAWKERVGQELDRVVAFWMEHSHDQEHGGFFTCLGREGRVYDDLKYVWLQGRQVWMYCRLYRTFERFRHAQLLDAAKAGGEFLLRYARVAPPGKKCAFVLTRDGRPVKVQRTIFSECFYTMAMNELWRATGEVRYQTEAVEMMDQIVHWVQEDASGLGRPQLQGAPAAEPMAVPMMLLNLVEQLGEADEELAGKYAELGDWCARRILQHVQRDGQAVLENVSEGGKELPGCLGRQQNPGHTLEAGWFLLRHCIRKGDPELRAHVIDKFLLLPFHSGWDPDHGGLFYFQDADNFCPTQLEWAMKLWWPHSEAMIAFLMGYSDSGDPVLLRLFYQVAEYTFRQFRDPEYGEWFGYLSREGKVALSIKGGPFKGCFHVPRCLAMCEEMLGALLSRPAPAPSPAPTPACRGAE

SEQ ID NO: 649 - protein, 728 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 650 - protein, 116 aa, Homo sapiens; identical to SEQ ID NO: 134

SEQ ID NO: 651 - protein, 766 aa, Homo sapiens; identical to SEQ ID NO: 135

SEQ ID NO: 652 - protein, 1676 aa, Homo sapiens
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVILNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGVGISNTGICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 653 - protein, 1170 aa, Homo sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILACDPGLSRTCDQNTYLSGLCYLFRQNLQGPMLQGRPGFQECIKGNVDLVFLFDGSMSLQPDEFQKILDFMKDVMKKLSNTSYQFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAQGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 654 - protein, 20 aa, Homo sapiens
SELKYPFLFLLPTHSNFSLE

SEQ ID NO: 655 - protein, 45 aa, Homo sapiens
AIMHMKTLKKWLSIYILKEAAAFIPELCKQMKKIAGSFLDKVLYS

SEQ ID NO: 656 - protein, 107 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKVIRILKLRHMS

SEQ ID NO: 657 - DNA, 1742 bp, Homo sapiens; identical to SEQ ID NO: 183

SEQ ID NO: 658 - protein, 557 aa, Homo sapiens
MMVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEERIENIYSRHKIYKLSPETTYCLKVKAALLTSWKIGVYSPVHCIKTTVENELPPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNIRSLSDSFHIYIGAPKQSGNTPVIQDYPLIYEIIFWENTSNAERKIIEKKTDVTVPNLKPLTVYCVKARAHTMDEKLNKSSVFSDAVCEKTKPGNTSKIWLIVGICIALFALPFVIYAAKVFLRCINYVFFPSLKPSSSIDEYFSEQPLKNLLLSTSEEQIEKCFIIENISTIATVEETNQTDEDHKKYSSQTSQDSGNYSNEDESESKTSEELQQDFV

SEQ ID NO: 659 - protein, 6 aa, Homo sapiens
PPAPGE

SEQ ID NO: 660 - protein, 146 aa, Homo sapiens
AARLGRQMRALRLGAEDQPLPAWIPQLRAVYCRPIPARPACQAACPGCRRHAAGATHALGRCADSAGAAPRAAGGAGWRELGGLGSRGALRDRCRRCWTAAGSASTLVPSAACAPTCCQRRQLQEMLVSRRKTAAPAVWRARPSPA

SEQ ID NO: 661 - protein, 6 aa, Homo sapiens
GLYRPG

SEQ ID NO: 662 - protein, 8 aa, Homo sapiens
AASTCRGA

SEQ ID NO: 663 - protein, 10 aa, Homo sapiens
ARAGRGGSCL

SEQ ID NO: 664 - protein, 34 aa, Homo sapiens
QAGAQWRDLSSLQPPPPVFKLFSRLSLPSILLGL

SEQ ID NO: 665 - protein, 51 aa, Homo sapiens
AFCLRAIGVKTYRKTTVEILEGKKGDPGVSQAIQRYATKSVTFLSVQKLNA

SEQ ID NO: 666 - protein, 43 aa, Homo sapiens
LLSWEWQKLYGQLIPNKIWTNMFNVGQEHGRLTSSYLLGTRCK

SEQ ID NO: 667 - protein, 28 aa, Homo sapiens
HMFGTMTFMLKLNQIYQVTESHGRGKKI

SEQ ID NO: 668 - protein, 43 aa, Homo sapiens
GRSCESNCKVLCCKYRLSQLSHQCNFHTNHCSCFYVDRGSLLV

SEQ ID NO: 669 - protein, 15 aa, Homo sapiens
SMQAHVVKKQTLSSD

SEQ ID NO: 670 - protein, 6 aa, Homo sapiens
SHMEGT

SEQ ID NO: 671 - protein, 26 aa, Homo sapiens
TQCTQNVTWVSQLQKTTLTITEIQQS

SEQ ID NO: 672 - protein, 33 aa, Homo sapiens
ITFTFSSQLRSPKPWSMLEWISRQCGILMKTME

SEQ ID NO: 673 - protein, 3 aa, Homo sapiens
VVY

SEQ ID NO: 674 - protein, 1676 aa, Homo sapiens; identical to SEQ ID NO: 147

SEQ ID NO: 675 - DNA, 3595 bp, Homo sapiens
  misc_feature (108)..(914): CDS
gctttcagtcgagggctagcgagcgcagcggagcctggagagaaggcgctgggctgcgagggcgcgagggcgcgagggcagggggcaaccggaccccgcccttacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgggttgtggaaagcctctgctgccatggtgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttacacgtcgacccctgg

SEQ ID NO: 676 - DNA, 3390 bp, Homo sapiens
  misc_feature (108)..(1175): CDS
gctttcagtcgagggctagcgagcgcagcggagcctggagagaaggcgctgggctgcgagggcgcgagggcgcgagggcagggggcaaccggaccccgcccttacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttgattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgggttgtggaaagcctctgctgccatggtgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttacacgtcgacccctgg

SEQ ID NO: 677 - DNA, 185 bp, Homo sapiens
gctttcagtcgagggctagcgagcgcagcggagcctggagagaaggcgctgggctgcgagggcgcgagggcgcgagggcagggggcaaccggaccccgcccttacccatggcgcccgtcgccgtctgggccgcgctggccgtcggactggagctctgggctgcggcgcacgccttgcccgcccag

SEQ ID NO: 678 - DNA, 174 bp, Homo sapiens
ggttttgcagctcactagaggcagagccaagactccaccccaggtggccaggctcctgagcgctatgcctacctcaccctccaatgaggtggtggtggaggagaccgtgagccgctgtcacctgaacactggtgcactcagtctgctgctctgaggacgccgccccctctcttt

SEQ ID NO: 679 - DNA, 129 bp, Homo sapiens
gccaacatgcaaaagtcttctgtaccaagacctcggacaccgtgtgtgactcctgtgaggacagcacatacacccagctctggaactgggttcccgagtgcttgagctgtggctcccgctgtagctctg

SEQ ID NO: 680 - DNA, 145 bp, Homo sapiens
gtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccag

SEQ ID NO: 681 - DNA, 205 bp, Homo sapiens
cctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcag

SEQ ID NO: 682 - DNA, 1139 bp, Homo sapiens
attcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgggttgtggaaagcctctgctgccatggtgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactc

SEQ ID NO: 683 - DNA, 787 bp, Homo sapiens
cagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgt

SEQ ID NO: 684 - DNA, 277 bp, Homo sapiens
ctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgt

SEQ ID NO: 685 - DNA, 293 bp, Homo sapiens
ctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttacacgtcgacccctgg

SEQ ID NO: 686 - DNA, 100 bp, Homo sapiens
gtggcatttacaccctacgccccggagcccgggagcacatgccggctcagagaatactatgaccagacagctcagatgtgctgcagcaaatgctcgccgg

SEQ ID NO: 687 - DNA, 5 bp, Homo sapiens
accag

SEQ ID NO: 688 - DNA, 83 bp, Homo sapiens
acctctcctagggctctagtgccaaggcccagctgtcccgcagagtgtctgagtggttgacaagttcggattgttccctgaag

SEQ ID NO: 689 - DNA, 94 bp, Homo sapiens
gaactgaaacatcagacgtggtgtgcaagccctgtgccccggggacgttctccaacacgacttcatccacggatatttgcaggccccaccagat

SEQ ID NO: 690 - DNA, 103 bp, Homo sapiens
ctgtaacgtggtggccatccctgggaatgcaagcatggatgcagtctgcacgtccacgtcccccacccggagtatggccccaggggcagtacacttaccccag

SEQ ID NO: 691 - DNA, 89 bp, Homo sapiens
ccagtgtccacacgatcccaacacacgcagccaactccagaacccagcactgctccaagcacctccttcctgctcccaatgggccccag

SEQ ID NO: 692 - DNA, 44 bp, Homo sapiens
ccccccagctgaagggagcactggcgacttcgctcttccagttg

SEQ ID NO: 693 - DNA, 71 bp, Homo sapiens
gactgattgtgggtgtgacagccttgggtctactaataataggagtggtgaactgtgtcatcatgacccag

SEQ ID NO: 694 - DNA, 7 bp, Homo sapiens
gtgaaaa

SEQ ID NO: 695 - DNA, 35 bp, Homo sapiens
agaagcccttgtgcctgcagagagaagccaaggtg

SEQ ID NO: 696 - protein, 355 aa, Homo sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 697 - protein, 31 aa, Homo sapiens
MAPVAVWAALAVGLELWAAAHALPAQGFAAH

SEQ ID NO: 698 - protein, 60 aa, Homo sapiens
MAPVAVWAALAVGLELWAAAHALPAQANMQKSSVPRPRTPCVTPVRTAHTPSSGTGFPSA

SEQ ID NO: 699 - protein, 155 aa, Homo sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPDLS

SEQ ID NO: 700 - DNA, 2990 bp, Homo sapiens
  misc_feature (32)..(2740): CDS
atatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaactttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaacactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattacatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcgttggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagagtctcgccctgtcgcccaggctggagtgcaatgggaagatctcgggtcactgcaagctccgcctgccaggttcaagcgattctcctgcctcagcctcccaagtagctgggattacaggcacacaccaccatgcccagccaacttgacagcattttaaagtgtcatgcatatcactatactgccatattttatttaatctttaaattttcagtgcatttccatcatatcaaaataagaaacaagtacatctgtgatattttgggcttagttcctgttaattacctttcctcctgagtgtgggttacactttcctatttctttttatctagtaattttggattgaatcttctactttattaataaaaatattataaagactctggattctattacatt

SEQ ID NO: 701 - DNA, 2235 bp, Homo sapiens
  misc_feature (32)..(1549): CDS
atatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaactttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaacactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttggtaagtacataatgatggatttacatcttattcccccacctggaacattttcctttgcctctagagaggcattagaattatcctttatacttttattcccaaagcactttcaagagcatcatctaacttgaacatcagtttctcaaaaaacctttgaaatagggcatgattttcatgaccatttcacagatgaggaaactgagggacagagaagttaaaagacttatgatggttactcagctgggaagaggaaaattttgatttgagctgaggactctgactcctgttctaataacactttttaccaaagagagcctagttattccaaagcgagaacctgattaaatcatgttgcctctgttctctttcatggccaaagattatatgcctagacccagttcggataagtgaattttattgtcaaaaaatggggaagcaaaatcctctcctgagaattgaatcctatcttgcctgttccaattccgtagctgagcaacatccctattgcatcatttatattaaacagaggtggatcgatgaagcctgttggtgaaaccaagaaaaaaacttacagaaaatattaagagcttcctgacaatcaccaaataaatggaatgaattatttcgacagccaggccaagtacatgctgttggcttttcaacatttttgaggaagaaattgaaaaaacagtaatgag

SEQ ID NO: 702 - protein, 1112 aa, Homo sapiens
  misc_feature (32)..(925): CDS
ATATATCCGTGGTTTCCTGCTACCTCCAACCATGGGCCTTTTGGGAATACTTTGTTTTTTAATCTTCCTGGGGAAAACCTGGGGACAGGAGCAAACATATGTCATTTCAGCACCAAAAATATTCCGTGTTGGAGCATCTGAAAATATTGTGATTCAAGTTTATGGATACACTGAAGCATTTGATGCAACAATCTCTATTAAAAGTTATCCTGATAAAAAATTTAGTTACTCCTCAGGCCATGTTCATTTATCCTCAGAGAATAAATTCCAAAACTCTGCAATCTTAACAATACAACCAAAACAATTGCCTGGAGGACAAAACCCAGTTTCTTATGTGTATTTGGAAGTTGTATCAAAGCATTTTTCAAAATCAAAAAGAATGCCAATAACCTATGACAATGGATTTCTCTTCATTCATACAGACAAACCTGTTTATACTCCAGACCAGTCAGTAAAAGTTAGAGTTTATTCGTTGAATGACGACTTGAAGCCAGCCAAAAGAGAAACTGTCTTAACTTTCATAGATCCTGAAGGATCAGAAGTTGACATGGTAGAAGAAATTGATCATATTGGAATTATCTCTTTTCCTGACTTCAAGATTCCGTCTAATCCTAGATATGGTATGTGGACGATCAAGGCTAAATATAAAGAGGACTTTTCAACAACTGGAACCGCATATTTTGAAGTTAAAGAATATGTCTTGCCACATTTTTCTGTCTCAATCGAGCCAGAATATAATTTCATTGGTTACAAGAACTTTAAGAATTTTGAAATTACTATAAAAGCAAGATATTTTTATAATAAAGTAGTCACTGAGGCTGACGTTTATATCACATTTGGAATAAGAGAAGACTTAAAAGATGATCAAAAAGAAATGATGCAAACAGCAATGCAAAACACAATGTTAAGGGCGGAAGTACGCTGAGAGGCCTATAAAGATGAATGATGACGCAGGAATTGGAAGAAGTCGTGTTTGTCAGCTATTACCAAAAAGACCTGTTGGACCATGTGATGTTCAAGACCCTTCTACTTCTATAATTCTATACAAATAATTAGAAAATAACATCCTGGGCTTAATCGTGGACTCGGTTATCTACTTTACTTTTGACACT

SEQ ID NO: 703 - DNA, 193 bp, Homo sapiens
atatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaaca

SEQ ID NO: 704 - DNA, 163 bp, Homo sapiens
atacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcag

SEQ ID NO: 705 - DNA, 208 bp, Homo sapiens
ttaagggcggaagtacgctgagaggcctataaagatgaatgatgacgcaggaattggaagaagtcgtgtttgtcagctattaccaaaaagacctgttggaccatgtgatgttcaagacccttctacttctataattctatacaaataattagaaaataacatcctgggcttaatcgtggactcggttatctactttacttttgacact

SEQ ID NO: 706 - DNA, 127 bp, Homo sapiens
ttgataaatggaattgctcaagtcacatttgattctgaaacagcagtcaaagaactgtcatactacagtttagaagatttaaacaacaagtacctttatattgctgtaacagtcatagagtctacag

SEQ ID NO: 707 - DNA, 186 bp, Homo sapiens
gtgcaggttaaagattcgcttgaccagttggtaggaggagtcccagtaacactgaatgcacaaacaattgatgtaaaccaagagacatctgacttggatccaagcaaaagtgtaacacgtgttgatgatggagtagcttcctttgtgcttaatctcccatctggagtgacggtgctggagtttaat

SEQ ID NO: 708 - DNA, 204 bp, Homo sapiens
gtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttg

SEQ ID NO: 709 - DNA, 698 bp, Homo sapiens
gtaagtacataatgatggatttacatcttattcccccacctggaacattttcctttgcctctagagaggcattagaattatcctttatacttttattcccaaagcactttcaagagcatcatctaacttgaacatcagtttctcaaaaaacctttgaaatagggcatgattttcatgaccatttcacagatgaggaaactgagggacagagaagttaaaagacttatgatggttactcagctgggaagaggaaaattttgatttgagctgaggactctgactcctgttctaataacactttttaccaaagagagcctagttattccaaagcgagaacctgattaaatcatgttgcctctgttctctttcatggccaaagattatatgcctagacccagttcggataagtgaattttattgtcaaaaaatggggaagcaaaatcctctcctgagaattgaatcctatcttgcctgttccaattccgtagctgagcaacatccctattgcatcatttatattaaacagaggtggatcgatgaagcctgttggtgaaaccaagaaaaaaacttacagaaaatattaagagcttcctgacaatcaccaaataaatggaatgaattatttcgacagccaggccaagtacatgctgttggcttttcaacatttttgaggaagaaattgaaaaaacagtaatgag

SEQ ID NO: 710 - DNA, 210 bp, Homo sapiens
attttatccaagggcaaaattatccactttggcacgagggagaaattttcagatgcatcttatcaaagtataaacattccagtaacacagaacatggttccttcatcccgacttctggtctattacatcgtcacaggagaacagacagcagaattagtgtctgattcagtctggttaaatattgaagaaaaatgtggcaaccagctccag

SEQ ID NO: 711 - DNA, 150 bp, Homo sapiens
gttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaaga

SEQ ID NO: 712 - DNA, 130 bp, Homo sapiens
gtatttcaattcttagagaagagtgatctgggctgtggggcaggtggtggcctcaacaatgccaatgtgttccacctagctggacttaccttcctcactaatgcaaatgcagatgactcccaagaaaatg

SEQ ID NO: 713 - DNA, 198 bp, Homo sapiens
ctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctac

SEQ ID NO: 714 - DNA, 140 bp, Homo sapiens
gtatatgtgttgctgatactgtcaaggcaaaggtgttcaaagatgtcttcctggaaatgaatataccatattctgttgtacgaggagaacagatccaattgaaaggaactgtttacaactataggacttctgggatgcag

SEQ ID NO: 715 - DNA, 397 bp, Homo sapiens
agtctcgccctgtcgcccaggctggagtgcaatgggaagatctcgggtcactgcaagctccgcctgccaggttcaagcgattctcctgcctcagcctcccaagtagctgggattacaggcacacaccaccatgcccagccaacttgacagcattttaaagtgtcatgcatatcactatactgccatattttatttaatctttaaattttcagtgcatttccatcatatcaaaataagaaacaagtacatctgtgatattttgggcttagttcctgttaattacctttcctcctgagtgtgggttacactttcctatttctttttatctagtaattttggattgaatcttctactttattaataaaaatattataaagactctggattctattacatt

SEQ ID NO: 716 - DNA, 96 bp, Homo sapiens
atatatccgtggtttcctgctacctccaaccatgggccttttgggaatactttgttttttaatcttcctggggaaaacctggggacaggagcaaac

SEQ ID NO: 717 - DNA, 71 bp, Homo sapiens
taaaagttagagtttattcgttgaatgacgacttgaagccagccaaaagagaaactgtcttaactttcata

SEQ ID NO: 718 - DNA, 92 bp, Homo sapiens
gatcctgaaggatcagaagttgacatggtagaagaaattgatcatattggaattatctcttttcctgacttcaagattccgtctaatcctag

SEQ ID NO: 719 - DNA, 83 bp, Homo sapiens
atatggtatgtggacgatcaaggctaaatataaagaggacttttcaacaactggaaccgcatattttgaagttaaagaatatg

SEQ ID NO: 720 - DNA, 91 bp, Homo sapiens
tcttgccacatttttctgtctcaatcgagccagaatataatttcattggttacaagaactttaagaattttgaaattactataaaagcaag

SEQ ID NO: 721 - DNA, 115 bp, Homo sapiens
atatttttataataaagtagtcactgaggctgacgtttatatcacatttggaataagagaagacttaaaagatgatcaaaaagaaatgatgcaaacagcaatgcaaaacacaatg

SEQ ID NO: 722 - DNA, 116 bp, Homo sapiens
gtggattttctgaagaggcagaaatacctggcatcaaatatgtcctctctccctacaaactgaatttggttgctactcctcttttcctgaagcctgggattccatatcccatcaag

SEQ ID NO: 723 - DNA, 63 bp, Homo sapiens
atgaaccttgtaaagaaattctcaggccaagaagaacgctgcaaaagaagatagaagaaatag

SEQ ID NO: 724 - DNA, 91 bp, Homo sapiens
acatgaagaccctgttaccagtaagcaagccagaaattcggagttattttccagaaagctggttgtgggaagttcatcttgttcccagaag

SEQ ID NO: 725 - DNA, 53 bp, Homo sapiens
aaaacagttgcagtttgccctacctgattctctaaccacctgggaaattcaag

SEQ ID NO: 726 - DNA, 21 bp, Homo sapiens
gcgttggcatttcaaacactg

SEQ ID NO: 727 - protein, 902 aa, Homo sapiens
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGVGISNTGICVADTVKAKVFKDVFLEMNIPYSVVRGEQIQLKGTVYNYRTSGMQSLALSPRLECNGKISGHCKLRLPGSSDSPASASQVAGITGTHHHAQPT

SEQ ID NO: 728 - protein, 505 aa, Homo sapiens
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLVST

SEQ ID NO: 729 - protein, 297 aa, Homo sapiens; identical to SEQ ID NO: 104

SEQ ID NO: 730 - protein, 1676 aa, Homo sapiens; identical to SEQ ID NO: 652

SEQ ID NO: 731 - DNA, 8887 bp, Homo sapiens
  misc_feature (124)..(7074): CDS
attcccacggcggcagcggaagagggagggccgggcgcgccgcggctgcttgcagtctccgcaagcggctacatcacagagctcagcgtgcggtgtcacaggccccgcggtcccgcccaacagatgcaccgagatgcgcgtgcgcagaaagcgtcccggggatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggaggcaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttaataatcttattttggcattcttttcccattgactatatacatctctatttctcaaatgttcatggaactagctcttttattttcctgctggtttcttcagtaatgagttaaataaaacattgacacatacaaacaaaaaac

SEQ ID NO: 732 - DNA, 8974 bp, Homo sapiens
  misc_feature (124)..(7161): CDS
attcccacggcggcagcggaagagggagggccgggcgcgccgcggctgcttgcagtctccgcaagcggctacatcacagagctcagcgtgcggtgtcacaggccccgcggtcccgcccaacagatgcaccgagatgcgcgtgcgcagaaagcgtcccggggtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggaggcaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttaataatcttattttggcattcttttcccattgactatatacatctctatttctcaaatgttcatggaactagctcttttattttcctgctggtttcttcagtaatgagttaaataaaacattgacacatacaaacaaaaaac

SEQ ID NO: 733 - DNA, 1339 bp, Homo sapiens
  misc_feature (124)..(921): CDS
attcccacggcggcagcggaagagggagggccgggcgcgccgcggctgcttgcagtctccgcaagcggctacatcacagagctcagcgtgcggtgtcacaggccccgcggtcccgcccaacagatgcaccgagatgcgcgtgcgcagaaagcgtcccggggatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtatgtacacacctgctcaacaatcctcagggtcttccaaattcagcaccagagttctgtacttcagttcacaaacagctcggcatctcagaggatatagcccactgaatacttgaagatctctggcctctggggatcttaatgtatagtaggcaattcctcttttggtcacctgaaaatgaaggcttacccatgtacatacagcccacagtcagatttttctttccttttcttaaatgtgagtgggcaaccaaggatgaacagacatttaaaaagaacctaaaatatggaagggatatgcaaagatgaacaaagaaaataataatcccagaataaaaaaagctatggctcagaacagaactcatcggaagctcttacttctattttcataaagattcaagaagatactgcatcaataaagtaacaataagatgccttccagttttaaaataggggcatagaggcaggctggctttactccctctcacagaaaaccaaaaccaaacatacagcaccaatatctacaaccaacaa

SEQ ID NO: 734 - DNA, 1493 bp, Homo sapiens
  misc_feature (173)..(1075): CDS
tgcttagtgctgagcacatccagtgggtaaagttccttaaaatgctctgcaaagaaattgggacttttcattaaatcagaaattttacttttttcccctcctgggagctaaagatattttagagaagaattaaccttttgcttctccagttgaacatttgtagcaataagtcatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtatgtacacacctgctcaacaatcctcagggtcttccaaattcagcaccagagttctgtacttcagttcacaaacagctcggcatctcagaggatatagcccactgaatacttgaagatctctggcctctggggatcttaatgtatagtaggcaattcctcttttggtcacctgaaaatgaaggcttacccatgtacatacagcccacagtcagatttttctttccttttcttaaatgtgagtgggcaaccaaggatgaacagacatttaaaaagaacctaaaatatggaagggatatgcaaagatgaacaaagaaaataataatcccagaataaaaaaagctatggctcagaacagaactcatcggaagctcttacttctattttcataaagattcaagaagatactgcatcaataaagtaacaataagatgccttccagttttaaaataggggcatagaggcaggctggctttactccctctcacagaaaaccaaaaccaaacatacagcaccaatatctacaaccaacaa

SEQ ID NO: 735 - DNA, 161 bp, Homo sapiens
attcccacggcggcagcggaagagggagggccgggcgcgccgcggctgcttgcagtctccgcaagcggctacatcacagagctcagcgtgcggtgtcacaggccccgcggtcccgcccaacagatgcaccgagatgcgcgtgcgcagaaagcgtcccgggg

SEQ ID NO: 736 - DNA, 228 bp, Homo sapiens
tgcttagtgctgagcacatccagtgggtaaagttccttaaaatgctctgcaaagaaattgggacttttcattaaatcagaaattttacttttttcccctcctgggagctaaagatattttagagaagaattaaccttttgcttctccagttgaacatttgtagcaataagtcatgcaaatagagctctccacctgcttctttctgtgccttttgcgattctgctttag

SEQ ID NO: 737 - DNA, 122 bp, Homo sapiens
atttcctcctagagtgccaaaatcttttccattcaacacctcagtcgtgtacaaaaagactctgtttgtagaattcacggatcaccttttcaacatcgctaagccaaggccaccctggatgg

SEQ ID NO: 738 - DNA, 123 bp, Homo sapiens
gtctgctaggtcctaccatccaggctgaggtttatgatacagtggtcattacacttaagaacatggcttcccatcctgtcagtcttcatgctgttggtgtatcctactggaaagcttctgagg

SEQ ID NO: 739 - DNA, 213 bp, Homo sapiens
gagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaag

SEQ ID NO: 740 - DNA, 534 bp, Homo sapiens
gtatgtacacacctgctcaacaatcctcagggtcttccaaattcagcaccagagttctgtacttcagttcacaaacagctcggcatctcagaggatatagcccactgaatacttgaagatctctggcctctggggatcttaatgtatagtaggcaattcctcttttggtcacctgaaaatgaaggcttacccatgtacatacagcccacagtcagatttttctttccttttcttaaatgtgagtgggcaaccaaggatgaacagacatttaaaaagaacctaaaatatggaagggatatgcaaagatgaacaaagaaaataataatcccagaataaaaaaagctatggctcagaacagaactcatcggaagctcttacttctattttcataaagattcaagaagatactgcatcaataaagtaacaataagatgccttccagttttaaaataggggcatagaggcaggctggctttactccctctcacagaaaaccaaaaccaaacatacagcaccaatatctacaaccaacaa

SEQ ID NO: 741 - DNA, 222 bp, Homo sapiens
gtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatg

SEQ ID NO: 742 - DNA, 262 bp, Homo sapiens
atggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacag

SEQ ID NO: 743 - DNA, 172 bp, Homo sapiens
aagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttg

SEQ ID NO: 744 - DNA, 215 bp, Homo sapiens
gtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccag

SEQ ID NO: 745 - DNA, 151 bp, Homo sapiens
ataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcaca

SEQ ID NO: 746 - DNA, 210 bp, Homo sapiens
gcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccag

SEQ ID NO: 747 - DNA, 3106 bp, Homo sapiens
gtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacag

SEQ ID NO: 748 - DNA, 154 bp, Homo sapiens
ggctcagagtggcagtgtccctcagttcaagaaagttgttttccaggaatttactgatggctcctttactcagcccttataccgtggagaactaaatgaacatttgggactcctggggccatatataagagcagaagttgaagataatatcatg

SEQ ID NO: 749 - DNA, 213 bp, Homo sapiens
gtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctg

SEQ ID NO: 750 - DNA, 229 bp, Homo sapiens
gaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatg

SEQ ID NO: 751 - DNA, 183 bp, Homo sapiens
caatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccag

SEQ ID NO: 752 - DNA, 241 bp, Homo sapiens
acagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatg

SEQ ID NO: 753 - DNA, 145 bp, Homo sapiens
gtcttctttggcaatgtggattcatctgggataaaacacaatatttttaaccctccaattattgctcgatacatccgtttgcacccaactcattatagcattcgcagcactcttcgcatggagttgatgggctgtgatttaaata

SEQ ID NO: 754 - DNA, 149 bp, Homo sapiens
gttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcag

SEQ ID NO: 755 - DNA, 150 bp, Homo sapiens
gtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggact

SEQ ID NO: 756 - DNA, 1904 bp, Homo sapiens
tcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggaggcaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttaataatcttattttggcattcttttcccattgactatatacatctctatttctcaaatgttcatggaactagctcttttattttcctgctggtttcttcagtaatgagttaaataaaacattgacacatacaaacaaaaaac

SEQ ID NO: 757 - DNA, 87 bp, Homo sapiens
tgccaccagaagatactacctgggtgcagtggaactgtcatgggactatatgcaaagtgatctcggtgagctgcctgtggacgcaag

SEQ ID NO: 758 - DNA, 69 bp, Homo sapiens
ggagtctggccaaggaaaagacacagaccttgcacaaatttatactactttttgctgtatttgatgaag

SEQ ID NO: 759 - DNA, 117 bp, Homo sapiens
ggaaaagttggcactcagaaacaaagaactccttgatgcaggatagggatgctgcatctgctcgggcctggcctaaaatgcacacagtcaatggttatgtaaacaggtctctgccag

SEQ ID NO: 760 - DNA, 94 bp, Homo sapiens
attatatttaagaatcaagcaagcagaccatataacatctaccctcacggaatcactgatgtccgtcctttgtattcaaggagattaccaaaag

SEQ ID NO: 761 - DNA, 117 bp, Homo sapiens
gtgtttttgagacagtggaaatgttaccatccaaagctggaatttggcgggtggaatgccttattggcgagcatctacatgctgggatgagcacactttttctggtgtacagcaata

SEQ ID NO: 762 - DNA, 73 bp, Homo sapiens
agtgtcagactcccctgggaatggcttctggacacattagagattttcagattacagcttcaggacaatatgg

SEQ ID NO: 763 - DNA, 27 bp, Homo sapiens
ctcttttttcagaatggcaaagtaaag

SEQ ID NO: 764 - DNA, 65 bp, Homo sapiens
gtttttcagggaaatcaagactccttcacacctgtggtgaactctctagacccaccgttactgac

SEQ ID NO: 765 - protein, 300 aa, Homo sapiens
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGMYTPAQQSSGSSKFSTRVLYFSSQTARHLRGYSPLNT

SEQ ID NO: 766 - protein, 2316 aa, Homo sapiens
MHRDARAQKASRGFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 767 - protein, 2345 aa, Homo sapiens
MHRDARAQKASRGATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 768 - protein, 265 aa, Homo sapiens [sequence omitted]

SEQ ID NO: 769 - protein, 2351 aa, Homo sapiens
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 770 - DNA, 3705 bp, Homo sapiens
  misc_feature (713)..(1591): CDS
atttgctttaaagcagagatgacttacatttctgataactactttcccttaattcatgattcacacacatttggagggctggactttctgggtttggttatttcccctggtaccaatccccgccttttcccagaaatcacttgactttcccgaaaactcagaaacacaccctttggctgaaaaatagcattaagcaatcggtgaaattccccattcctcctttccccgctggagccctggatagagggctctctggcctgggaggaggacgctgtccttgtttcaaaagcagagggagctccaagatcaaggctgagtttccctaagtcatggtctcccagccccctctgtttagatcagggaatttcagacatgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatcgtgagtaacttagaagtgcctctttggttggtgataccaaagtccccaaacaatgtgggatcaaagcaggtagatgatccaggcacactggaagcacctgtgatctcagctaccgagggaggctgaggcaggaggatcccttgagcccaggaagtaggagtttgagtccactctgggcaacagagcaaaaccttgtctctaaaacaaaacaaaaacaaagcaacaataatttaaaaaacagatagattgttgttctgatagaatcctgagatacttcacttcttcaggaaaatctaaaccagtcaacggttgctagaaatgcctcaacctctagtaatcctttaactagacctgagactgcagacagcttgcgggtggttagttggtaatgccatatgattttagacatctgctgtattggaatgttaagcatcaggattgaggacaactggacgattttagaaagtgtgagaatgatgtaaatagaatgagagtcttcaactatttagtaattttttcctcctgtcccaacttctgttctttcaagcaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagca

SEQ ID NO: 771 - DNA, 3188 bp, Homo sapiens
  misc_feature (713)..(1705): CDS
atttgctttaaagcagagatgacttacatttctgataactactttcccttaattcatgattcacacacatttggagggctggactttctgggtttggttatttcccctggtaccaatccccgccttttcccagaaatcacttgactttcccgaaaactcagaaacacaccctttggctgaaaaatagcattaagcaatcggtgaaattccccattcctcctttccccgctggagccctggatagagggctctctggcctgggaggaggacgctgtccttgtttcaaaagcagagggagctccaagatcaaggctgagtttccctaagtcatggtctcccagccccctctgtttagatcagggaatttcagacatgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagaaataagtggtgatgtttattattctccagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagca

SEQ ID NO: 772 - DNA, 3373 bp, Homo sapiens
  misc_feature (713)..(2080): CDS
atttgctttaaagcagagatgacttacatttctgataactactttcccttaattcatgattcacacacatttggagggctggactttctgggtttggttatttcccctggtaccaatccccgccttttcccagaaatcacttgactttcccgaaaactcagaaacacaccctttggctgaaaaatagcattaagcaatcggtgaaattccccattcctcctttccccgctggagccctggatagagggctctctggcctgggaggaggacgctgtccttgtttcaaaagcagagggagctccaagatcaaggctgagtttccctaagtcatggtctcccagccccctctgtttagatcagggaatttcagacatgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccaggactgaacagtgacctgccagagtccagctcagtgaggtggcagtatcactgtgccgtgggctgccagggccgtggggaacctcctcagccgcactgaagccaggccaactggaaggaaatagaaacgtcagccagcgacagttggtgtctggtaatgtagctgcagtgagaagatacagaactgctaaaaacagggcctgaaagctgagagtgttctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagca

SEQ ID NO: 773 - DNA, 2116 bp, Homo sapiens
  misc_feature (713)..(1930): CDS
atttgctttaaagcagagatgacttacatttctgataactactttcccttaattcatgattcacacacatttggagggctggactttctgggtttggttatttcccctggtaccaatccccgccttttcccagaaatcacttgactttcccgaaaactcagaaacacaccctttggctgaaaaatagcattaagcaatcggtgaaattccccattcctcctttccccgctggagccctggatagagggctctctggcctgggaggaggacgctgtccttgtttcaaaagcagagggagctccaagatcaaggctgagtttccctaagtcatggtctcccagccccctctgtttagatcagggaatttcagacatgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacgtatgtgtctcttcaaagtggaagtctttctttttctctcagagagaatggaaagatcagcacatcaaaattcaaatgcatggtttcctcttaggcatgtgagggagtgggttgggtttttgaagggaagccagtcatggaagcttttctagtcccagccccgcatctggtcccaggccaactagatcggcatgtttctttccaagaaaggggctatgggataggtcgagttagtagccccacgtgggtgcatttgtggcttccactgggccttcaccaaccactgagaaccaggctcttcactacggctttcatggggccatctgaattggcatctc

SEQ ID NO: 774 - DNA, 2960 bp, Homo sapiens
  misc_feature (713)..(2581): CDS
atttgctttaaagcagagatgacttacatttctgataactactttcccttaattcatgattcacacacatttggagggctggactttctgggtttggttatttcccctggtaccaatccccgccttttcccagaaatcacttgactttcccgaaaactcagaaacacaccctttggctgaaaaatagcattaagcaatcggtgaaattccccattcctcctttccccgctggagccctggatagagggctctctggcctgggaggaggacgctgtccttgtttcaaaagcagagggagctccaagatcaaggctgagtttccctaagtcatggtctcccagccccctctgtttagatcagggaatttcagacatgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagca

SEQ ID NO: 775 - DNA, 545 bp, Homo sapiens
atttgctttaaagcagagatgacttacatttctgataactactttcccttaattcatgattcacacacatttggagggctggactttctgggtttggttatttcccctggtaccaatccccgccttttcccagaaatcacttgactttcccgaaaactcagaaacacaccctttggctgaaaaatagcattaagcaatcggtgaaattccccattcctcctttccccgctggagccctggatagagggctctctggcctgggaggaggacgctgtccttgtttcaaaagcagagggagctccaagatcaaggctgagtttccctaagtcatggtctcccagccccctctgtttagatcagggaatttcagacatgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagctt

SEQ ID NO: 776 - DNA, 188 bp, Homo sapiens
gtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaact

SEQ ID NO: 777 - DNA, 178 bp, Homo sapiens
ataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacag

SEQ ID NO: 778 - DNA, 126 bp, Homo sapiens
acataaatgaatgcacagattttgtagatgtcccttgtagccacttctgcaacaatttcattggtggttacttctgctcctgccccccggaatatttcctccatgatgacatgaagaattgcggag

SEQ ID NO: 779 - DNA, 200 bp, Homo sapiens
ttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtt

SEQ ID NO: 780 - DNA, 154 bp, Homo sapiens
tttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatc

SEQ ID NO: 781 - DNA, 547 bp, Homo sapiens
gtgagtaacttagaagtgcctctttggttggtgataccaaagtccccaaacaatgtgggatcaaagcaggtagatgatccaggcacactggaagcacctgtgatctcagctaccgagggaggctgaggcaggaggatcccttgagcccaggaagtaggagtttgagtccactctgggcaacagagcaaaaccttgtctctaaaacaaaacaaaaacaaagcaacaataatttaaaaaacagatagattgttgttctgatagaatcctgagatacttcacttcttcaggaaaatctaaaccagtcaacggttgctagaaatgcctcaacctctagtaatcctttaactagacctgagactgcagacagcttgcgggtggttagttggtaatgccatatgattttagacatctgctgtattggaatgttaagcatcaggattgaggacaactggacgattttagaaagtgtgagaatgatgtaaatagaatgagagtcttcaactatttagtaattttttcctcctgtcccaacttctgttctttcaag

SEQ ID NO: 782 - DNA, 338 bp, Homo sapiens
gtatgtgtctcttcaaagtggaagtctttctttttctctcagagagaatggaaagatcagcacatcaaaattcaaatgcatggtttcctcttaggcatgtgagggagtgggttgggtttttgaagggaagccagtcatggaagcttttctagtcccagccccgcatctggtcccaggccaactagatcggcatgtttctttccaagaaaggggctatgggataggtcgagttagtagccccacgtgggtgcatttgtggcttccactgggccttcaccaaccactgagaaccaggctcttcactacggctttcatggggccatctgaattggcatctc

SEQ ID NO: 783 - DNA, 215 bp, Homo sapiens
gactgaacagtgacctgccagagtccagctcagtgaggtggcagtatcactgtgccgtgggctgccagggccgtggggaacctcctcagccgcactgaagccaggccaactggaaggaaatagaaacgtcagccagcgacagttggtgtctggtaatgtagctgcagtgagaagatacagaactgctaaaaacagggcctgaaagctgagagtgt

SEQ ID NO: 784 - DNA, 207 bp, Homo sapiens
gacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctc

SEQ ID NO: 785 - DNA, 170 bp, Homo sapiens
caatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtc

SEQ ID NO: 786 - DNA, 348 bp, Homo sapiens
ctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaattttgtgtgacttacctcattccacaccaaaccctcagaattatagaaggggaatgggatgagaaggctgttatgtcactgaaattgggcatccagcaactaatatttaatttaattgtcacgaaaacagggaattcagcttttcttctctcttccaaatgagatttactgaata

SEQ ID NO: 787 - DNA, 6 bp, Homo sapiens
ctgaag

SEQ ID NO: 788 - DNA, 80 bp, Homo sapiens
gtgacactgagccccaggtgacgccgcaccaccaaagaaggtgcttgtgtttgtcagacaaatacagccaggcctgccac

SEQ ID NO: 789 - DNA, 7 bp, Homo sapiens
cccttag

SEQ ID NO: 790 - DNA, 79 bp, Homo sapiens
gctccaaagtccggaggtgcagaaagccaggaccaagagacaggcagctcaccagggtggacaaatcgccagagatgtg

SEQ ID NO: 791 - DNA, 20 bp, Homo sapiens
gtgcgtatgactcagtgcag

SEQ ID NO: 792 - DNA, 45 bp, Homo sapiens
caatgccctgccctaaggaagacactcccaattctgtttgggagc

SEQ ID NO: 793 - DNA, 20 bp, Homo sapiens
ctgcgaaggcaaaatatgtc

SEQ ID NO: 794 - DNA, 51 bp, Homo sapiens
tttagagatgtggtgcagataacctgtctggatgggtttgaagttgtggag

SEQ ID NO: 795 - DNA, 30 bp, Homo sapiens
aaataagtggtgatgtttattattctccag

SEQ ID NO: 796 - DNA, 79 bp, Homo sapiens
ggacgtgttggtgcaacatctttctattcgacttgtcaaagcaatggaaagtggagtaattccaaactgaaatgtcaac

SEQ ID NO: 797 - DNA, 50 bp, Homo sapiens
ctgtggactgtggcattcctgaatccattgagaatggtaaagttgaagac

SEQ ID NO: 798 - DNA, 11 bp, Homo sapiens
ccagagagcac

SEQ ID NO: 799 - DNA, 27 bp, Homo sapiens
tttgtttggttctgtcatccgctacac

SEQ ID NO: 800 - DNA, 41 bp, Homo sapiens
ttgtgaggagccatattactacatggaaaatggaggaggtg

SEQ ID NO: 801 - DNA, 75 bp, Homo sapiens
gggagtatcactgtgctggtaacgggagctgggtgaatgaggtgctgggcccggagctgccgaaatgtgttccag

SEQ ID NO: 802 - DNA, 51 bp, Homo sapiens
tctgtggagtccccagagaaccctttgaagaaaaacagaggataattggag

SEQ ID NO: 803 - DNA, 66 bp, Homo sapiens
gatccgatgcagatattaaaaacttcccctggcaagtcttctttgacaacccatgggctggtggag

SEQ ID NO: 804 - DNA, 67 bp, Homo sapiens
cgctcattaatgagtactgggtgctgacggctgctcatgttgtggagggaaacagggagccaacaat

SEQ ID NO: 805 - DNA, 32 bp, Homo sapiens
gtatgttgggtccacctcagtgcagacctcac

SEQ ID NO: 806 - DNA, 78 bp, Homo sapiens
ggctggcaaaatccaagatgctcactcctgagcatgtgtttattcatccgggatggaagctgctggaagtcccagaag

SEQ ID NO: 807 - DNA, 7 bp, Homo sapiens
ctttaag

SEQ ID NO: 808 - DNA, 13 bp, Homo sapiens
aaaatgcaaagaa

SEQ ID NO: 809 - DNA, 89 bp, Homo sapiens
gtgaaagtggagaaacccacagcagatgcagaggcctatgttttcactcctaacatgatctgtgctggaggagagaagggcatggatag

SEQ ID NO: 810 - DNA, 117 bp, Homo sapiens
ctgtaaaggggacagtggtggggcctttgctgtacaggatcccaatgacaagaccaaattctacgcagctggcctggtgtcctgggggccccagtgtgggacctatgggctctacac

SEQ ID NO: 811 - DNA, 13 bp, Homo sapiens
acgggtaaagaac

SEQ ID NO: 812 - DNA, 22 bp, Homo sapiens
tatgttgactggataatgaaga

SEQ ID NO: 813 - DNA, 32 bp, Homo sapiens
ctatgcaggaaaatagcaccccccgtgaggac

SEQ ID NO: 814 - DNA, 22 bp, Homo sapiens
taatccagatacatcccaccag

SEQ ID NO: 815 - DNA, 19 bp, Homo sapiens
cctctccaagggtggtgac

SEQ ID NO: 816 - protein, 455 aa, Homo sapiens; identical to SEQ ID NO: 98

SEQ ID NO: 817 - protein, 405 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQRMCLFKVEVFLFLSERMERSAHQNSNAWFPLRHVREWVGFLKGSQSWKLF

SEQ ID NO: 818 - protein, 622 aa, Homo sapiens; identical to SEQ ID NO: 95

SEQ ID NO: 819 - protein, 292 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDRE

SEQ ID NO: 820 - protein, 330 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEK

SEQ ID NO: 821 - protein, 688 aa, Homo sapiens; identical to SEQ ID NO: 146

SEQ ID NO: 822 - DNA, 824 bp, Homo sapiens
  misc_feature (109)..(708): CDS
agagaaggggccagggtataaaaagggcccacaagagaccagctcaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcattttgtctga

SEQ ID NO: 823 - DNA, 1131 bp, Homo sapiens
  misc_feature (109)..(750): CDS
agagaaggggccagggtataaaaagggcccacaagagaccagctcaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatgggggtgagggtggcgccaggggtccccaatcctggagccccactgactttgagagctgtgttagagaaacactgctgccctctttttagcagtcaggccctgacccaagagaactcaccttattcttcatttcccctcgtgaatcctccaggcctttctctacaccctgaaggggagggaggaaaatgaatgaatgagaaagggagggaacagtacccaagcgcttggcctctccttctcttccttcactttgcagaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcattttgtctga

SEQ ID NO: 824 - DNA, 876 bp, Homo sapiens
  misc_feature (109)..(645): CDS
agagaaggggccagggtataaaaagggcccacaagagaccagctcaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatgggggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcattttgtctga

SEQ ID NO: 825 - DNA, 672 bp, Homo sapiens
  misc_feature (109)..(300): CDS
agagaaggggccagggtataaaaagggcccacaagagaccagctcaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcattttgtctga

SEQ ID NO: 826 - DNA, 593 bp, Homo sapiens
  misc_feature (109)..(477): CDS
agagaaggggccagggtataaaaagggcccacaagagaccagctcaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcattttgtctga

SEQ ID NO: 827 - DNA, 161 bp, Homo sapiens
gctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagttt

SEQ ID NO: 828 - DNA, 246 bp, Homo sapiens
gtgagggtggcgccaggggtccccaatcctggagccccactgactttgagagctgtgttagagaaacactgctgccctctttttagcagtcaggccctgacccaagagaactcaccttattcttcatttcccctcgtgaatcctccaggcctttctctacaccctgaaggggagggaggaaaatgaatgaatgagaaagggagggaacagtacccaagcgcttggcctctccttctcttccttcac

SEQ ID NO: 829 - DNA, 161 bp, Homo sapiens
atcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggctt

SEQ ID NO: 830 - DNA, 118 bp, Homo sapiens
agagaaggggccagggtataaaaagggcccacaagagaccagctcaaggatcccaaggcccaactccccgaaccactcagggtcctgtggacagctcacctagctgcaatggctacag

SEQ ID NO: 831 - DNA, 45 bp, Homo sapiens
gaagaagcctatatcccaaaggaacagaagtattcattcctgcag

SEQ ID NO: 832 - DNA, 9 bp, Homo sapiens
aacccccag

SEQ ID NO: 833 - DNA, 59 bp, Homo sapiens
acctccctctgtttctcagagtctattccgacaccctccaacagggaggaaacacaaca

SEQ ID NO: 834 - DNA, 7 bp, Homo sapiens
gaaatcc

SEQ ID NO: 835 - DNA, 3 bp, Homo sapiens
aac

SEQ ID NO: 836 - DNA, 42 bp, Homo sapiens
ctagagctgctccgcatctccctgctgctcatccagtcgtgg

SEQ ID NO: 837 - DNA, 9 bp, Homo sapiens
ctggagccc

SEQ ID NO: 838 - DNA, 6 bp, Homo sapiens
gtgcag

SEQ ID NO: 839 - DNA, 26 bp, Homo sapiens
ttcctcaggagtgtcttcgccaacag

SEQ ID NO: 840 - DNA, 1 bp, Homo sapiens
c

SEQ ID NO: 841 - DNA, 78 bp, Homo sapiens
ctggtgtacggcgcctctgacagcaacgtctatgacctcctaaaggacctagaggaaggcatccaaacgctgatgggg

SEQ ID NO: 842 - DNA, 7 bp, Homo sapiens
tttgcag

SEQ ID NO: 843 - DNA, 2 bp, Homo sapiens
ag

SEQ ID NO: 844 - DNA, 15 bp, Homo sapiens
gctggaagatggcag

SEQ ID NO: 845 - DNA, 9 bp, Homo sapiens
cccccggac

SEQ ID NO: 846 - DNA, 7 bp, Homo sapiens
tgggcag

SEQ ID NO: 847 - DNA, 55 bp, Homo sapiens
ctagctgcccgggtggcatccctgtgacccctccccagtgcctctcctggccctg

SEQ ID NO: 848 - DNA, 65 bp, Homo sapiens
gaagttgccactccagtgcccaccagccttgtcctaataaaattaagttgcatcattttgtctga

SEQ ID NO: 849 - protein, 217 aa, Homo sapiens; identical to SEQ ID NO: 640

SEQ ID NO: 850 - protein, 217 aa, Homo sapiens; identical to SEQ ID NO: 640

SEQ ID NO: 851 - protein, 199 aa, Homo sapiens
MATGSRTSLLLAFGLLCLPWLQEGSAFPTIPLSRLFDNAMLRAHRLHQLAFDTYQEFTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 852 - protein, 213 aa, Homo sapiens
MATGSRTSLLLAFGLLCLPWLQEGSAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGVRVAPGVPNPGAPLTLRAVLEKHCCPLFSSQALTQENSPYSSFPLVNPPGLSLHPEGEGGK

SEQ ID NO: 853 - protein, 178 aa, Homo sapiens
MATGSRTSLLLAFGLLCLPWLQEGSAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGAGRWQPPDWADLQADLQQVRHKLTQR

SEQ ID NO: 854 - protein, 122 aa, Homo sapiens
MATGSRTSLLLAFGLLCLPWLQEGSAFPTIPLSRLFDNAMLRAHRLHQLAFDTYQEFRLEDGSPRTGQIFKQTYSKFDTNSHNDDALLKNYGLLYCFRKDMDKVETFLRIVQCRSVEGSCGF

SEQ ID NO: 855 - protein, 63 aa, Homo sapiens
MATGSRTSLLLAFGLLCLPWLQEGSAFPTIPLSRLFDNAMLRAHRLHQLAFDTYQEFPGVRRL

SEQ ID NO: 856 - DNA, 1294 bp, Homo sapiens
cggaattagggagatagttggtattaggattaggattgttgtgaagtatagtacggatgctacttgtgcaatgatggtaaaagggtagcttactggttgtcctccgattcaggttagaatgaggaggtctgcggcttggagctcctggggcctaacaaaaagaaacctgccatgctgctcttcctcctctctgcactggtcctgctcacacagcccctgggctacctggaagcagaaatgaagacctactcccacagaacaatgcccagtgcttgcaccctggtcatgtgtagctcagtggagagtggcctgcctggtcgcgatggacgggatgggagagagggccctcggggcgagaagggggacccaggtttgccaggagctgcagggcaagcagggatgcctggacaagctggcccagttgggcccaaaggggacaatggctctgttggagaacctggaccaaagggagacactgggccaagtggagaagtaggtgccccaggcatgcagggctcggcaggggcaagaggcctcgcaggccctaagggagagcgaggtgtccctggtgagcgtggagtccctggaaacacaggggcagcagggtctgctggagccatgggtccccagggaagtccaggtgccaggggacccccgggattgaagggggacaaaggcattcctggagacaaaggagcaaagggagaaagtgggcttccagatgttgcttctctgaggcagcaggttgaggccttacagggacaagtacagcacctccaggctgctttctctcagtataagaaagttgagctcttcccaaatggccaaagtgtcggggagaagattttcaagacagcaggctttgtaaaaccatttacggaggcacagctgctgtgcacacaggctggtggacagttggcctctccacgctctgccgctgagaatgccgccttgcaacagctggtcgtagctaagaacgaggctgctttcctgagcatgactgattccaagacagagggcaagttcacctaccccacaggagagtccctggtctattccaactgggccccaggggagcccaacgatgatggcgggtcagaggactgtgtggagatcttcaccaatggcaagtggaatgacagggcttgtggagaaaagcgtcttgtggtctgcgagttctgagccaactggggtgggtggggcagtgcttggcccaggagtttggccagaagtcaaggcttagaccctcatgctgccaatatcctaataaaaaggtgaccatctgtgccgggaa

SEQ ID NO: 857 - protein, 336 aa, Homo sapiens
MLLFLLSALVLLTQPLGYLEAEMKTYSHRTMPSACTLVMCSSVESGLPGRDGRDGREGPRGEKGDPGLPGAAGQAGMPGQAGPVGPKGDNGSVGEPGPKGDTGPSGEVGAPGMQGSAGARGLAGPKGERGVPGERGVPGNTGAAGSAGAMGPQGSPGARGPPGLKGDKGIPGDKGAKGESGLPDVASLRQQVEALQGQVQHLQAAFSQYKKVELFPNGQSVGEKIFKTAGFVKPFTEAQLLCTQAGGQLASPRSAAENAALQQLVVAKNEAAFLSMTDSKTEGKFTYPTGESLVYSNWAPGEPNDDGGSEDCVEIFTNGKWNDRACGEKRLVVCEF

SEQ ID NO: 858 - protein, 375 aa, Homo sapiens
MLLFLLSALVLLTQPLGYLEAEMKTYSHRTMPSACTLVMCSSVESGLPGRDGRDGREGPRGEKGDPGLPGAAGQAGMPGQAGPVGPKGDNGSVGEPGPKGDTGPSGPPGPPGVPGPAGREGALGKQGNIGPQGKPGPKGEAGPKGEVGAPGMQGSAGARGLAGPKGERGVPGERGVPGNTGAAGSAGAMGPQGSPGARGPPGLKGDKGIPGDKGAKGESGLPDVASLRQQVEALQGQVQHLQAAFSQYKKVELFPNGQSVGEKIFKTAGFVKPFTEAQLLCTQAGGQLASPRSAAENAALQQLVVAKNEAAFLSMTDSKTEGKFTYPTGESLVYSNWAPGEPNDDGGSEDCVEIFTNGKWNDRACGEKRLVVCEF

SEQ ID NO: 859 - protein, 375 aa, Homo sapiens; identical to SEQ ID NO: 858

SEQ ID NO: 860 - protein, 152 aa, Homo sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSGGNSSLHSGTEPHLHLQARLVLRAEQAGGVPAVRAAAQVPPGLRRGQTRN

SEQ ID NO: 861 - protein, 268 aa, Homo sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVASLACR

SEQ ID NO: 862 - protein, 461 aa, Homo sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 863 - DNA, 6417 bp, Homo sapiens
  misc_feature (261)..(761): CDS
gattgcgacaggccggcctggctcccagcgctccctgtccccgccccgcggccagctcgctccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaaggtcagaggtccctgaggggctggatgtgaaaaggaggctgggtgccagggatctcaagtgggagcagggaatatggtactgtgtccacggcgaccccccagatccttggcttaaaattcctcttctcattccatgcagaggctcacagaagggttctggagggacatggaactgggacaggtgcaggggacacaggaggtggttcttctcagtactgggaagcttgggcaaaatggtaggcagtaggccgggtgtggtggcccacgcctgtaatcccagcactttgggaggccgaggtgggcggatcacgaggtcaggagatcgagaccatcctggctaacacagtgaaaccccgtctctactaaaaatacaaaaaattagccgggcgtggtggtgggcgcctgtagtcccagctactcgggaggctgaggcaggagaatggcgtgaacttgggaggcggagcttgcagtgagccgagatcgcgccactgcactccagcctgggcgacagagcaagactccgtctcaaaaaaaaaaaaaaaaaaggcagcaaagcagagcttgggaaaggtgagagctacgcaatggggtggatgggcatcctgaggcttaaaggaaactcacaggccggcaaagggcccctcccttttgcccattcaccctggctggcctgcctttctcttgccagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggtgagggaccagggctgagggacacaggggggggcgcctctgaaaatgccttaatgctccacatcttaaaaaaaatggggaaaagatgaacacttccctcccagaattgggcaagaagaaagttccttacagaaaaaattggagtatctctaggctagtttacacacacacacacacacacacacacacacttttaaaattatatatactgtaatactatgtcaaggaacacatcccacactgagatgtaatgataactactattgtcatcattttgggcttaccaacattacacaatccgtttttttttttcacacaatccattaactagaccaaacacctctttattagactatatacttttattattagacagaagattcccatttgactctttcttgactgtttcctgtggactgattggcttgctagcctagtagatgactattgtttctaatgactgtaacatcactaattggcagaaggttcactgtgtgtgttgggcactctgtaaccactttacatttactaactcatttaatcttcttaatgatgctatgaagtagattctattatcatcctcatggactgaaggaagaaaccgaggctcaaagaggttaagtgatatactcaagatcacccacacaggtggtcactggtgttattagaacctgtactcaggttttcttactccagagcccatgtcataatgcatgcactatagaaaattagagacttcagataagcaaaactaaaaactcacccacagagccactacctagaatatccactcgttacattgtggtatatatcctcccggacattttctatgcatgtttatacatactgggttttgttgttgtttactaaaagtgaagtaattttaatatttcgtaacctgattttttcattccacaatctaagtatttttctgtgccctgttaatttttaactatgtatcaaatacaactggcattttagagctggaattttagagagtatgtaagctaacctcatcctatatatgaaaaactgatgcccaaagaagtgaaatgacttaaaagtcacacagccgggcaggaaaccgtggcccagactcccagtccagtttctccccaggcctcccatcccatattcccttaggctacagatttacatgaatgagaagaggcaaaatgcccagcatagaaatgcgggagtcctcccgcccttccccaggcgtagctgacggacactggaggctccatgctattgctggcagcactggtacccagagaaagagaaattacccactgctacagatcacagctggagaagccgaactccagcctctctttctcttcccctcctagaacctgccctgagcaagggggtggagaacttgcaagccctgctctaccaggcggccacaggcagttccgaagcaagtttccctactctctcacccctgtaaacacccccacaggtacaggtacagcagggcaaccctagctcctctacagcagcccctctgtacaatggctgaggccacagaaatgtggctctagcctgtgtctgtttacaactccaagtcccacccttccctactgtctcccaatcccacttccagaccttgaaaatcaactgcctaagctcccatcctgcacacacaagcctgcccaatcctggtctctgagcaggagggcacccacaccacccccaaacatgcccatccatgatacagtctctcctggctgccaagaggtcctcaagtccaacttagttccccttctctataacccaagggaagtttctctcattctgcctttaggagctgcattgtgtctagaaggaaaaaagctgctcccttttctctgtctgggttgcccagggatctggaaagctcttccttctcctcctcccctctgcccttcttggggctgtgatcaccctcctgtctgctgtcctggcaggaaccatgctgatgctggccgttctgctgccactggccttctttctgctccttgccaccgtcttctcctgcatctggaagagccacccttctctctgcaggaaactgggtaggaaagggttggatgcagtggatggttggcaatgggagccggagggaggaatattcaacttcctccggtgcaaccctccacaccctcaagactcccaatgcctacccccaacatagacatccttatcttcatccagctgcttattctgaggctggagatgagagtgacagtggcttgttcctctgggcccccgggtggtcaagttgctacacattgtgctgggatgtggaggctgaaaggctaggtctgaggcctgccggggagcctacacccatttcattctccattgcaggatcgctgctcaagaggcgtccgcaggtaatggcgggggctgagaaggcagcaagaaggggaagaggtgatgagggtacaaggtggagcagacaggaagagagtatgcaggctgactccacactcattcattcattcaactgatgatttactgaacatgccacgtaccaggcactgtcctaggcactgggcgtacagcagtgagcaaaacacagtacctcatttcctggagttcacatgcccatggagcaagaataagttaaactatatatcaggtggtataattgctaaacaaagcagggaaggggtcaatgagtgacagtggcaaaggatgggggtattttagacagagtggagagtgaaggcctctctgagaacctgatatttgagcggagagctgaagaagcaaggagccagccatggggttatctggggagaaagtgctccaggaagagggagcaaccagtgcaaagaccctgaggcagggggcatggggaggagcagaggcaagtggtgagttgccaaagcatgcggtggggtgtgggaactaaagaaagatgagccagcctgggcaacacagccagaccccatctctacccaaaatgttgttccaagttagccaggcagggccaggtgcagtggctcacgcccaagctcccatcctgcacgcacaagcctgcccaatcctggtctctgaacaggagggcacccgcaccacccccaaacatgccgatccatgatacatgtaatcccagtactttgggaggccaaggcgggtggatcacctgaggtcaggggtttgagaccagcccggccaacatggcaaaaccccatctctactaaaaatacaaaaattagctgggcgtggtggcaggcacctgtaatcccagctactcaggaggctgaggcaggagaattgcttgaaccgtggaggcggaagttgcagttgaactgagattatgccactgcactccagcctgggtgacagagtgagactctgtctcaaaaaaaaaaaaaaaaaaaagttagccagacagtcccagctactcaggaggctgaggctagaggatcacttgagtccaagagttcatgagcctgcagtgagctatgattgcaccactgcactgtagcctgggtgacagaccctgaccctgtctggaaagaaagaaagagagagagagaaagagagagagagagagaaaggaaggaaggaaagaaagaaagagaaagagagaaagaagagggagggagggagagagaaaaaagggtctggggccctcatcattgtttgggtctccatctctttcctgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 864 - DNA, 4033 bp, Homo sapiens
  misc_feature (261)..(1028): CDS
gattgcgacaggccggcctggctcccagcgctccctgtccccgccccgcggccagctcgctccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcagaacctgccctgagcaagggggtggagaacttgcaagccctgctctaccaggcggccacaggcagttccgaagcaagtttccctactctctcacccctgtaaacacccccacaggagctgcattgtgtctagaaggaaaaaagctgctcccttttctctgtctgggttgcccagggatctggaaagctcttccttctcctcctcccctctgcccttcttggggctgtgatcaccctcctgtctgctgtcctggcaggaaccatgctgatgctggccgttctgctgccactggccttctttctgctccttgccaccgtcttctcctgcatctggaagagccacccttctctctgcaggaaactgggtaggaaagggttggatgcagtggatggttggcaatgggagccggagggaggaatattcaacttcctccggtgcaaccctccacaccctcaagactcccaatgcctacccccaacatagacatccttatcttcatccagctgcttattctgaggctggagatgagagtgacagtggcttgttcctctgggcccccgggtggtcaagttgctacacattgtgctgggatgtggaggctgaaaggctaggtctgaggcctgccggggagcctacacccatttcattctccattgcaggatcgctgctcaagaggcgtccgcaggtaatggcgggggctgagaaggcagcaagaaggggaagaggtgatgagggtacaaggtggagcagacaggaagagagtatgcaggctgactccacactcattcattcattcaactgatgatttactgaacatgccacgtaccaggcactgtcctaggcactgggcgtacagcagtgagcaaaacacagtacctcatttcctggagttcacatgcccatggagcaagaataagttaaactatatatcaggtggtataattgctaaacaaagcagggaaggggtcaatgagtgacagtggcaaaggatgggggtattttagacagagtggagagtgaaggcctctctgagaacctgatatttgagcggagagctgaagaagcaaggagccagccatggggttatctggggagaaagtgctccaggaagagggagcaaccagtgcaaagaccctgaggcagggggcatggggaggagcagaggcaagtggtgagttgccaaagcatgcggtggggtgtgggaactaaagaaagatgagccagcctgggcaacacagccagaccccatctctacccaaaatgttgttccaagttagccaggcagggccaggtgcagtggctcacgcccaagctcccatcctgcacgcacaagcctgcccaatcctggtctctgaacaggagggcacccgcaccacccccaaacatgccgatccatgatacatgtaatcccagtactttgggaggccaaggcgggtggatcacctgaggtcaggggtttgagaccagcccggccaacatggcaaaaccccatctctactaaaaatacaaaaattagctgggcgtggtggcaggcacctgtaatcccagctactcaggaggctgaggcaggagaattgcttgaaccgtggaggcggaagttgcagttgaactgagattatgccactgcactccagcctgggtgacagagtgagactctgtctcaaaaaaaaaaaaaaaaaaaagttagccagacagtcccagctactcaggaggctgaggctagaggatcacttgagtccaagagttcatgagcctgcagtgagctatgattgcaccactgcactgtagcctgggtgacagaccctgaccctgtctggaaagaaagaaagagagagagagaaagagagagagagagagaaaggaaggaaggaaagaaagaaagagaaagagagaaagaagagggagggagggagagagaaaaaagggtctggggccctcatcattgtttgggtctccatctctttcctgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 865 - DNA, 3681 bp, Homo sapiens
  misc_feature (261)..(806): CDS
gattgcgacaggccggcctggctcccagcgctccctgtccccgccccgcggccagctcgctccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggtaggaaagggttggatgcagtggatggttggcaatgggagccggagggaggaatattcaacttcctccggtgcaaccctccacaccctcaagactcccaatgcctacccccaacatagacatccttatcttcatccagctgcttattctgaggctggagatgagagtgacagtggcttgttcctctgggcccccgggtggtcaagttgctacacattgtgctgggatgtggaggctgaaaggctaggtctgaggcctgccggggagcctacacccatttcattctccattgcaggatcgctgctcaagaggcgtccgcaggtaatggcgggggctgagaaggcagcaagaaggggaagaggtgatgagggtacaaggtggagcagacaggaagagagtatgcaggctgactccacactcattcattcattcaactgatgatttactgaacatgccacgtaccaggcactgtcctaggcactgggcgtacagcagtgagcaaaacacagtacctcatttcctggagttcacatgcccatggagcaagaataagttaaactatatatcaggtggtataattgctaaacaaagcagggaaggggtcaatgagtgacagtggcaaaggatgggggtattttagacagagtggagagtgaaggcctctctgagaacctgatatttgagcggagagctgaagaagcaaggagccagccatggggttatctggggagaaagtgctccaggaagagggagcaaccagtgcaaagaccctgaggcagggggcatggggaggagcagaggcaagtggtgagttgccaaagcatgcggtggggtgtgggaactaaagaaagatgagccagcctgggcaacacagccagaccccatctctacccaaaatgttgttccaagttagccaggcagggccaggtgcagtggctcacgcccaagctcccatcctgcacgcacaagcctgcccaatcctggtctctgaacaggagggcacccgcaccacccccaaacatgccgatccatgatacatgtaatcccagtactttgggaggccaaggcgggtggatcacctgaggtcaggggtttgagaccagcccggccaacatggcaaaaccccatctctactaaaaatacaaaaattagctgggcgtggtggcaggcacctgtaatcccagctactcaggaggctgaggcaggagaattgcttgaaccgtggaggcggaagttgcagttgaactgagattatgccactgcactccagcctgggtgacagagtgagactctgtctcaaaaaaaaaaaaaaaaaaaagttagccagacagtcccagctactcaggaggctgaggctagaggatcacttgagtccaagagttcatgagcctgcagtgagctatgattgcaccactgcactgtagcctgggtgacagaccctgaccctgtctggaaagaaagaaagagagagagagaaagagagagagagagagaaaggaaggaaggaaagaaagaaagagaaagagagaaagaagagggagggagggagagagaaaaaagggtctggggccctcatcattgtttgggtctccatctctttcctgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 866 - DNA, 187 bp, Homo sapiens
gattgcgacaggccggcctggctcccagcgctccctgtccccgccccgcggccagctcgctccactcccacttcctgagctccgccgtgggagccctggaggcccggcctggccgctcccggccctggggtgcacatcggccctgagtcccgtcccaggctctgggctcgggcagccgccgccaccg

SEQ ID NO: 867 - DNA, 276 bp, Homo sapiens
gtcagaggtccctgaggggctggatgtgaaaaggaggctgggtgccagggatctcaagtgggagcagggaatatggtactgtgtccacggcgaccccccagatccttggcttaaaattcctcttctcattccatgcagaggctcacagaagggttctggagggacatggaactgggacaggtgcaggggacacaggaggtggttcttctcagtactgggaagcttgggcaaaatggtaggcagtaggccgggtgtggtggcccacgcctgtaatcc

SEQ ID NO: 868 - DNA, 411 bp, Homo sapiens
cagcactttgggaggccgaggtgggcggatcacgaggtcaggagatcgagaccatcctggctaacacagtgaaaccccgtctctactaaaaatacaaaaaattagccgggcgtggtggtgggcgcctgtagtcccagctactcgggaggctgaggcaggagaatggcgtgaacttgggaggcggagcttgcagtgagccgagatcgcgccactgcactccagcctgggcgacagagcaagactccgtctcaaaaaaaaaaaaaaaaaaggcagcaaagcagagcttgggaaaggtgagagctacgcaatggggtggatgggcatcctgaggcttaaaggaaactcacaggccggcaaagggcccctcccttttgcccattcaccctggctggcctgcctttctcttgccag

SEQ ID NO: 869 - DNA, 1352 bp, Homo sapiens
gtgagggaccagggctgagggacacaggggggggcgcctctgaaaatgccttaatgctccacatcttaaaaaaaatggggaaaagatgaacacttccctcccagaattgggcaagaagaaagttccttacagaaaaaattggagtatctctaggctagtttacacacacacacacacacacacacacacacttttaaaattatatatactgtaatactatgtcaaggaacacatcccacactgagatgtaatgataactactattgtcatcattttgggcttaccaacattacacaatccgtttttttttttcacacaatccattaactagaccaaacacctctttattagactatatacttttattattagacagaagattcccatttgactctttcttgactgtttcctgtggactgattggcttgctagcctagtagatgactattgtttctaatgactgtaacatcactaattggcagaaggttcactgtgtgtgttgggcactctgtaaccactttacatttactaactcatttaatcttcttaatgatgctatgaagtagattctattatcatcctcatggactgaaggaagaaaccgaggctcaaagaggttaagtgatatactcaagatcacccacacaggtggtcactggtgttattagaacctgtactcaggttttcttactccagagcccatgtcataatgcatgcactatagaaaattagagacttcagataagcaaaactaaaaactcacccacagagccactacctagaatatccactcgttacattgtggtatatatcctcccggacattttctatgcatgtttatacatactgggttttgttgttgtttactaaaagtgaagtaattttaatatttcgtaacctgattttttcattccacaatctaagtatttttctgtgccctgttaatttttaactatgtatcaaatacaactggcattttagagctggaattttagagagtatgtaagctaacctcatcctatatatgaaaaactgatgcccaaagaagtgaaatgacttaaaagtcacacagccgggcaggaaaccgtggcccagactcccagtccagtttctccccaggcctcccatcccatattcccttaggctacagatttacatgaatgagaagaggcaaaatgcccagcatagaaatgcgggagtcctcccgcccttccccaggcgtagctgacggacactggaggctccatgctattgctggcagcactggtacccagagaaagagaaattacccactgctacagatcacagctggagaagccgaactccagcctctctttctcttcccctcctag

SEQ ID NO: 870 - DNA, 345 bp, Homo sapiens
gtacaggtacagcagggcaaccctagctcctctacagcagcccctctgtacaatggctgaggccacagaaatgtggctctagcctgtgtctgtttacaactccaagtcccacccttccctactgtctcccaatcccacttccagaccttgaaaatcaactgcctaagctcccatcctgcacacacaagcctgcccaatcctggtctctgagcaggagggcacccacaccacccccaaacatgcccatccatgatacagtctctcctggctgccaagaggtcctcaagtccaacttagttccccttctctataacccaagggaagtttctctcattctgcctttag

SEQ ID NO: 871 - DNA, 142 bp, Homo sapiens
gagctgcattgtgtctagaaggaaaaaagctgctcccttttctctgtctgggttgcccagggatctggaaagctcttccttctcctcctcccctctgcccttcttggggctgtgatcaccctcctgtctgctgtcctggcag

SEQ ID NO: 872 - DNA, 295 bp, Homo sapiens
gtaggaaagggttggatgcagtggatggttggcaatgggagccggagggaggaatattcaacttcctccggtgcaaccctccacaccctcaagactcccaatgcctacccccaacatagacatccttatcttcatccagctgcttattctgaggctggagatgagagtgacagtggcttgttcctctgggcccccgggtggtcaagttgctacacattgtgctgggatgtggaggctgaaaggctaggtctgaggcctgccggggagcctacacccatttcattctccattgcag

SEQ ID NO: 873 - DNA, 248 bp, Homo sapiens
gtaatggcgggggctgagaaggcagcaagaaggggaagaggtgatgagggtacaaggtggagcagacaggaagagagtatgcaggctgactccacactcattcattcattcaactgatgatttactgaacatgccacgtaccaggcactgtcctaggcactgggcgtacagcagtgagcaaaacacagtacctcatttcctggagttcacatgcccatggagcaagaataagttaaactatatatcag

SEQ ID NO: 874 - DNA, 636 bp, Homo sapiens
gtggtataattgctaaacaaagcagggaaggggtcaatgagtgacagtggcaaaggatgggggtattttagacagagtggagagtgaaggcctctctgagaacctgatatttgagcggagagctgaagaagcaaggagccagccatggggttatctggggagaaagtgctccaggaagagggagcaaccagtgcaaagaccctgaggcagggggcatggggaggagcagaggcaagtggtgagttgccaaagcatgcggtggggtgtgggaactaaagaaagatgagccagcctgggcaacacagccagaccccatctctacccaaaatgttgttccaagttagccaggcagggccaggtgcagtggctcacgcccaagctcccatcctgcacgcacaagcctgcccaatcctggtctctgaacaggagggcacccgcaccacccccaaacatgccgatccatgatacatgtaatcccagtactttgggaggccaaggcgggtggatcacctgaggtcaggggtttgagaccagcccggccaacatggcaaaaccccatctctactaaaaatacaaaaattagctgggcgtggtggcaggcacctgtaatcccagctactcaggaggctgaggcag

SEQ ID NO: 875 - DNA, 402 bp, Homo sapiens
gagaattgcttgaaccgtggaggcggaagttgcagttgaactgagattatgccactgcactccagcctgggtgacagagtgagactctgtctcaaaaaaaaaaaaaaaaaaaagttagccagacagtcccagctactcaggaggctgaggctagaggatcacttgagtccaagagttcatgagcctgcagtgagctatgattgcaccactgcactgtagcctgggtgacagaccctgaccctgtctggaaagaaagaaagagagagagagaaagagagagagagagagaaaggaaggaaggaaagaaagaaagagaaagagagaaagaagagggagggagggagagagaaaaaagggtctggggccctcatcattgtttgggtctccatctctttcctgcag

SEQ ID NO: 876 - DNA, 229 bp, Homo sapiens
ggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacg

SEQ ID NO: 877 - DNA, 235 bp, Homo sapiens
gtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacacc

SEQ ID NO: 878 - DNA, 149 bp, Homo sapiens
ctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaag

SEQ ID NO: 879 - DNA, 192 bp, Homo sapiens
gtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 880 - DNA, 20 bp, Homo sapiens
ctgcccaggacgtcgggcct

SEQ ID NO: 881 - DNA, 63 bp, Homo sapiens
cctgccttcctcccaggcccccacgttgctggccgcctggccgagtggccgccatgctcctgc

SEQ ID NO: 882 - DNA, 28 bp, Homo sapiens
cttgggccacctctgcccccggcctggc

SEQ ID NO: 883 - DNA, 58 bp, Homo sapiens
ctgggggcctctggtgctgggcctcttcgggctcctggcagcatcgcagccccaggcg

SEQ ID NO: 884 - DNA, 97 bp, Homo sapiens
gtgcctccatatgcgtcggagaaccagacctgcagggaccaggaaaaggaatactatgagccccagcaccgcatctgctgctcccgctgcccgccag

SEQ ID NO: 885 - DNA, 15 bp, Homo sapiens
gcacctatgtctcag

SEQ ID NO: 886 - DNA, 111 bp, Homo sapiens
ctaaatgtagccgcatccgggacacagtttgtgccacatgtgccgagaattcctacaacgagcactggaactacctgaccatctgccagctgtgccgcccctgtgacccag

SEQ ID NO: 887 - DNA, 34 bp, Homo sapiens
tgatgggcctcgaggagattgccccctgcacaag

SEQ ID NO: 888 - DNA, 119 bp, Homo sapiens
caaacggaagacccagtgccgctgccagccgggaatgttctgtgctgcctgggccctcgagtgtacacactgcgagctactttctgactgcccgcctggcactgaagccgagctcaaag

SEQ ID NO: 889 - DNA, 97 bp, Homo sapiens
atgaagttgggaagggtaacaaccactgcgtcccctgcaaggcagggcacttccagaatacctcctcccccagcgcccgctgccagccccacaccag

SEQ ID NO: 890 - DNA, 98 bp, Homo sapiens
gtgtgagaaccaaggtctggtggaggcagctccaggcactgcccagtccgacacaacctgcaaaaatccattagagccactgcccccagagatgtcag

SEQ ID NO: 891 - DNA, 113 bp, Homo sapiens
aacctgccctgagcaagggggtggagaacttgcaagccctgctctaccaggcggccacaggcagttccgaagcaagtttccctactctctcacccctgtaaacacccccacag

SEQ ID NO: 892 - DNA, 108 bp, Homo sapiens
gaaccatgctgatgctggccgttctgctgccactggccttctttctgctccttgccaccgtcttctcctgcatctggaagagccacccttctctctgcaggaaactgg

SEQ ID NO: 893 - DNA, 26 bp, Homo sapiens
gatcgctgctcaagaggcgtccgcag

SEQ ID NO: 894 - DNA, 107 bp, Homo sapiens
cagagccctaagggattaaggctcagacacctctgagagcaggtgggcactggctgggtacggtgccctccacaggactctccctactgcctgagcaaacctgaggc

SEQ ID NO: 895 - DNA, 119 bp, Homo sapiens
ctcccggcagacccacccaccccctggggctgctcagcctcaggcacggacagggcacatgataccaactgctgcccactacggcacgccgcaccggagcacggcaccgagggagccgc

SEQ ID NO: 896 - DNA, 32 bp, Homo sapiens
cacacggtcacctgcaaggacgtcacgggccc

SEQ ID NO: 897 - DNA, 73 bp, Homo sapiens
ctctaaaggattcgtggtgctcatccccaagcttcagagaccctttggggttccacacttcacgtggactgag

SEQ ID NO: 898 - protein, 166 aa, Homo sapiens [sequence omitted]

SEQ ID NO: 899 - protein, 255 aa, Homo sapiens; identical to SEQ ID NO: 178

SEQ ID NO: 900 - protein, 181 aa, Homo sapiens
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKGVRTKVWWRQLQALPSPTQPAKIH

SEQ ID NO: 901 - DNA, 1608 bp, Homo sapiens
  misc_feature (412)..(806): CDS
agacacggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcaccccgggagttaatccgaaagcgccgcaagccccgcgggccggccgcaccgttcgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactgtaagtcaaaaaatgaaaagtttcagcctgtatgatgaattcatatcactgatgtctgattattttttcctctagaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaattaaagtga

SEQ ID NO: 902 - DNA, 2024 bp, Homo sapiens
  misc_feature (412)..(695): CDS
agacacggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcaccccgggagttaatccgaaagcgccgcaagccccgcgggccggccgcaccgttcgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaaggtataaaggattttcctcccagagcatgcagtgtggttaaaaactgtgcatcaaatctcacctgcttctaaaaattcacgtttctggtatccatcattatgggattttaactggtcctacttcagaagttagatttgggagaaaaattatttttaaaaaatggttttttttgcaacaatgtgaatacacttaacacttaaaaatagttcagatgctaaatattatgatatgtgtttttaccataataaaaaaaatttgagacctgaagagtcagaaagatttatactaagaattaatactttgatatatgattttttccctctagaatgagagttgcctaaattccagagagacctctttcataactgtaagtcaaaaaatgaaaagtttcagcctgtatgatgaattcatatcactgatgtctgattattttttcctctagaatgggagttgcctggcctccagaaagacctcttttatgatggtaagacacacagctctttcctcaaatgcaatgggggaaatgtttttagcccatctcaatggatacttccccatcttgtcatgtcacccaggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaattaaagtga

SEQ ID NO: 903 - DNA, 1491 bp, Homo sapiens
  misc_feature (412)..(1031): CDS
agacacggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcaccccgggagttaatccgaaagcgccgcaagccccgcgggccggccgcaccgttcgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaattaaagtga

SEQ ID NO: 904 - DNA, 1419 bp, Homo sapiens
  misc_feature (412)..(959): CDS
agacacggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcaccccgggagttaatccgaaagcgccgcaagccccgcgggccggccgcaccgttcgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaattaaagtga

SEQ ID NO: 905 - DNA, 1335 bp, Homo sapiens
  misc_feature (412)..(875): CDS
agacacggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcaccccgggagttaatccgaaagcgccgcaagccccgcgggccggccgcaccgttcgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaattaaagtga

SEQ ID NO: 906 - DNA, 1389 bp, Homo sapiens
  misc_feature (412)..(929): CDS
agacacggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcaccccgggagttaatccgaaagcgccgcaagccccgcgggccggccgcaccgttcgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaattaaagtga

SEQ ID NO: 907 - DNA, 274 bp, Homo sapiens
agacacggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcaccccgggagttaatccgaaagcgccgcaagccccgcgggccggccgcaccgttcgtgtcaccgagaagctgatgtagagagagacacagaaggagacagaaagcaagagaccagagtcc

SEQ ID NO: 908 - DNA, 325 bp, Homo sapiens
gtataaaggattttcctcccagagcatgcagtgtggttaaaaactgtgcatcaaatctcacctgcttctaaaaattcacgtttctggtatccatcattatgggattttaactggtcctacttcagaagttagatttgggagaaaaattatttttaaaaaatggttttttttgcaacaatgtgaatacacttaacacttaaaaatagttcagatgctaaatattatgatatgtgtttttaccataataaaaaaaatttgagacctgaagagtcagaaagatttatactaagaattaatactttgatatatgattttttccctctag

SEQ ID NO: 909 - DNA, 144 bp, Homo sapiens
gccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcag

SEQ ID NO: 910 - DNA, 616 bp, Homo sapiens
gccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaattaaagtga

SEQ ID NO: 911 - DNA, 19 bp, Homo sapiens
cgggaaagtcctgccgcgc

SEQ ID NO: 912 - DNA, 28 bp, Homo sapiens
ctcgggacaattataaaaatgtggcccc

SEQ ID NO: 913 - DNA, 66 bp, Homo sapiens
ctgggtcagcctcccagccaccgccctcacctgccgcggccacaggtctgcatccagcggctcgcc

SEQ ID NO: 914 - DNA, 8 bp, Homo sapiens
ctgtgtcc

SEQ ID NO: 915 - DNA, 6 bp, Homo sapiens
ctgcag

SEQ ID NO: 916 - DNA, 28 bp, Homo sapiens
tgccggctcagcatgtgtccagcgcgca

SEQ ID NO: 917 - DNA, 77 bp, Homo sapiens
gcctcctccttgtggctaccctggtcctcctggaccacctcagtttggccagaaacctccccgtggccactccagac

SEQ ID NO: 918 - DNA, 26 bp, Homo sapiens
ccaggaatgttcccatgccttcacca

SEQ ID NO: 919 - DNA, 10 bp, Homo sapiens
ctcccaaaac

SEQ ID NO: 920 - DNA, 33 bp, Homo sapiens
ctgctgagggccgtcagcaacatgctccagaag

SEQ ID NO: 921 - DNA, 11 bp, Homo sapiens
gccagacaaac

SEQ ID NO: 922 - DNA, 103 bp, Homo sapiens
tctagaattttacccttgcacttctgaagagattgatcatgaagatatcacaaaagataaaaccagcacagtggaggcctgtttaccattggaattaaccaag

SEQ ID NO: 923 - DNA, 42 bp, Homo sapiens
aatgagagttgcctaaattccagagagacctctttcataact

SEQ ID NO: 924 - DNA, 75 bp, Homo sapiens
gtaagtcaaaaaatgaaaagtttcagcctgtatgatgaattcatatcactgatgtctgattattttttcctctag

SEQ ID NO: 925 - DNA, 42 bp, Homo sapiens
aatgggagttgcctggcctccagaaagacctcttttatgatg

SEQ ID NO: 926 - DNA, 91 bp, Homo sapiens
gtaagacacacagctctttcctcaaatgcaatgggggaaatgtttttagcccatctcaatggatacttccccatcttgtcatgtcacccag

SEQ ID NO: 927 - protein, 130 aa, Homo sapiens
MCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITVSQKMKSFSLYDEFISLMSDYFFL

SEQ ID NO: 928 - protein, 93 aa, Homo sapiens
MCPARSLLLVATLVLLDHLSLARNLPVATPDPGMFPCLHHSQNLLRAVSNMLQKARQTLEFYPCTSEEIDHEDITKDKTSTVEACLPLELTKV

SEQ ID NO: 929 - protein, 205 aa, Homo sapiens
MCPARSLLLVATLVLLDHLSLARNLPVATPDPGMFPCLHHSQNLLRAVSNMLQKARQTLEFYPCTSEEIDHEDITKDKTSTVEACLPLELTKNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 930 - protein, 181 aa, Homo sapiens
MCPARSLLLVATLVLLDHLSLARNLPVATPDPGMFPCLHHSQNLLRAVSNMLQKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 931 - protein, 153 aa, Homo sapiens
MCPARSLLLVATLVLLDHLSLARNLPVATPDPGMFPCLHHSQNLLRAVSNMLQKALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 932 - protein, 171 aa, Homo sapiens
MCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALNFNSETVPQKSSLEEPDFYKTKIKLCILLHAFRIRAVTIDRVMSYLNAS

SEQ ID NO: 933 - protein, 219 aa, Homo sapiens
MCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 934 - DNA, 3279 bp, Homo sapiens
  misc_feature (458)..(1054): CDS
gtaacaccatgtttggtaaataagtgttttggtgttgtgcaagggtctggtttcagcctgaagccatctcagagctgtctgggtctctggagactggagggacaacctagtctagagcccatttgcatgagaccaaggatcctcctgcaagagacaccatcctgagggaagagggcttctgaaccagcttgacccaataagaaattcttgggtgccgacgcggaagcagattcagagcctagagccgtgcctgcgtccgtagtttccttctagcttcttttgatttcaaatcaagacttacagggagagggagcgataaacacaaactctgcaagatgccacaaggtcctcctttgacatccccaacaaagaggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggtgggtgtgtcctcattccctcaacttggtgtgggggaagacaggctcaaagacagtgtcctggacaactcagggatgcaatgccacttccaaaagagaaggctacacgtaaacaaaagagtctgagaaatagtttctgattgttattgttaaatctttttttgtttgtttggttggttggctctcttctgcaaaggacatcaataactgtattttaaactatatattaactgaggtggattttaacatcaatttttaatagtgcaagagatttaaaaccaaaggcgggggggcgggcagaaaaaagtgcatccaactccagccagtgatccacagaaacaaagaccaaggagcacaaaatgattttaagattttagtcattgccaagtgacattcttctcactgtggttgtttcaattctttttcctaccttttaccagagagttagttcagagaaatggtcagagactcaagggtggaaagaggtaccaaaggctttggccaccagtagctggctattcagacagcagggagtagacttgctggctagcatgtggaggagccaaagctcaataagaaggggcctagaatgaaacccttggtgctgatcctgcctctgccatttctacttaagccagggtttctcatatgttaacatgcatgggaattccctgggcatcttcttgtggtgtggagtctgacttagcaagcctcgggtgggtttgagggtcaaatttctaccaggcttatatccctggtgatgctgcagaattccaggaccacacttggaggtttaaggccttccacaagttacttatcccatatggtgggtctatggaaaggtgtttcccagtcctctttacaccaccagatcagtggtctttcaacagatcctaaagggatggtgagagggaaactggagaaaagtatcagatttagaggccactgaagaacccatattaaaatgcctttaagtatgggctcttcattcatatactaaatatgaactatgtgccaggcattatttcatatgacagaatacaaacaaataagatagtgatgctggtcaggcttggtggctcatgcctgtattccctaaactttgggagcctaaggtgagaactccttgaactcctaaggccaggagttcaagaccagcctggataacatagcaagaccccatctctacaaaaaaccaaaaccaaacaaacaaaaatgatagtggtgcttccctcaggatgcttgtggtctaatgggagacagaacagcaaagggatgattagaagttggttgctgtgagccaggcacagtgctgatataatcccagcgctatgggaggctgaggtgggtggatcatttgaggccaggagtttaagaccagcctggtcaacatggtaaaaccccatctctacttaaaaatacaaaaaagttagccaggcatggtggcatacacctgtaacccagctactcaggaggctgaggcacatgaatcacttgaacccaggaggcagaggttgctgtgcaccactgcactccagcctgggtgacagaacgagaccttgactcaaaaaaaaaaaaaagaagtttgttgctatggaagggtcctactcagagcaggcaccccagttaatctcattcaccccacatttcacatttgaacatcatcccatagcccagagcatccctccactgcaaaggatttattcaacatttaaacaatcctttttactttcattttccttcaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattcagcaaataagagtg

SEQ ID NO: 935 - DNA, 1042 bp, Homo sapiens
  misc_feature (113)..(604): CDS
ttagagtctcaacccccaataaatataggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattcagcaaataagagtg

SEQ ID NO: 936 - DNA, 1482 bp, Homo sapiens
  misc_feature (458)..(745): CDS
gtaacaccatgtttggtaaataagtgttttggtgttgtgcaagggtctggtttcagcctgaagccatctcagagctgtctgggtctctggagactggagggacaacctagtctagagcccatttgcatgagaccaaggatcctcctgcaagagacaccatcctgagggaagagggcttctgaaccagcttgacccaataagaaattcttgggtgccgacgcggaagcagattcagagcctagagccgtgcctgcgtccgtagtttccttctagcttcttttgatttcaaatcaagacttacagggagagggagcgataaacacaaactctgcaagatgccacaaggtcctcctttgacatccccaacaaagaggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattcagcaaataagagtg

SEQ ID NO: 937 - DNA, 1420 bp, Homo sapiens
gtaacaccatgtttggtaaataagtgttttggtgttgtgcaagggtctggtttcagcctgaagccatctcagagctgtctgggtctctggagactggagggacaacctagtctagagcccatttgcatgagaccaaggatcctcctgcaagagacaccatcctgagggaagagggcttctgaaccagcttgacccaataagaaattcttgggtgccgacgcggaagcagattcagagcctagagccgtgcctgcgtccgtagtttccttctagcttcttttgatttcaaatcaagacttacagggagagggagcgataaacacaaactctgcaagatgccacaaggtcctcctttgacatccccaacaaagaggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattcagcaaataagagtg

SEQ ID NO: 938 - DNA, 373 bp, Homo sapiens
gtaacaccatgtttggtaaataagtgttttggtgttgtgcaagggtctggtttcagcctgaagccatctcagagctgtctgggtctctggagactggagggacaacctagtctagagcccatttgcatgagaccaaggatcctcctgcaagagacaccatcctgagggaagagggcttctgaaccagcttgacccaataagaaattcttgggtgccgacgcggaagcagattcagagcctagagccgtgcctgcgtccgtagtttccttctagcttcttttgatttcaaatcaagacttacagggagagggagcgataaacacaaactctgcaagatgccacaaggtcctcctttgacatccccaacaaagag

SEQ ID NO: 939 - DNA, 122 bp, Homo sapiens
tacccccaggagaagattccaaagatgtagccgccccacacagacagccactcacctcttcagaacgaattgacaaacaaattcggtacatcctcgacggcatctcagccctgagaaaggag

SEQ ID NO: 940 - DNA, 1745 bp, Homo sapiens
gtgggtgtgtcctcattccctcaacttggtgtgggggaagacaggctcaaagacagtgtcctggacaactcagggatgcaatgccacttccaaaagagaaggctacacgtaaacaaaagagtctgagaaatagtttctgattgttattgttaaatctttttttgtttgtttggttggttggctctcttctgcaaaggacatcaataactgtattttaaactatatattaactgaggtggattttaacatcaatttttaatagtgcaagagatttaaaaccaaaggcgggggggcgggcagaaaaaagtgcatccaactccagccagtgatccacagaaacaaagaccaaggagcacaaaatgattttaagattttagtcattgccaagtgacattcttctcactgtggttgtttcaattctttttcctaccttttaccagagagttagttcagagaaatggtcagagactcaagggtggaaagaggtaccaaaggctttggccaccagtagctggctattcagacagcagggagtagacttgctggctagcatgtggaggagccaaagctcaataagaaggggcctagaatgaaacccttggtgctgatcctgcctctgccatttctacttaagccagggtttctcatatgttaacatgcatgggaattccctgggcatcttcttgtggtgtggagtctgacttagcaagcctcgggtgggtttgagggtcaaatttctaccaggcttatatccctggtgatgctgcagaattccaggaccacacttggaggtttaaggccttccacaagttacttatcccatatggtgggtctatggaaaggtgtttcccagtcctctttacaccaccagatcagtggtctttcaacagatcctaaagggatggtgagagggaaactggagaaaagtatcagatttagaggccactgaagaacccatattaaaatgcctttaagtatgggctcttcattcatatactaaatatgaactatgtgccaggcattatttcatatgacagaatacaaacaaataagatagtgatgctggtcaggcttggtggctcatgcctgtattccctaaactttgggagcctaaggtgagaactccttgaactcctaaggccaggagttcaagaccagcctggataacatagcaagaccccatctctacaaaaaaccaaaaccaaacaaacaaaaatgatagtggtgcttccctcaggatgcttgtggtctaatgggagacagaacagcaaagggatgattagaagttggttgctgtgagccaggcacagtgctgatataatcccagcgctatgggaggctgaggtgggtggatcatttgaggccaggagtttaagaccagcctggtcaacatggtaaaaccccatctctacttaaaaatacaaaaaagttagccaggcatggtggcatacacctgtaacccagctactcaggaggctgaggcacatgaatcacttgaacccaggaggcagaggttgctgtgcaccactgcactccagcctgggtgacagaacgagaccttgactcaaaaaaaaaaaaaagaagtttgttgctatggaagggtcctactcagagcaggcaccccagttaatctcattcaccccacatttcacatttgaacatcatcccatagcccagagcatccctccactgcaaaggatttattcaacatttaaacaatcctttttactttcattttccttcag

SEQ ID NO: 941 - DNA, 457 bp, Homo sapiens
cagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatatt

SEQ ID NO: 942 - DNA, 28 bp, Homo sapiens
ttagagtctcaacccccaataaatatag

SEQ ID NO: 943 - DNA, 103 bp, Homo sapiens
gactggagatgtctgaggctcattctgccctcgagcccaccgggaacgaaagagaagctctatctcccctccaggagcccagctatgaactccttctccacaa

SEQ ID NO: 944 - DNA, 19 bp, Homo sapiens
gcgccttcggtccagttgc

SEQ ID NO: 945 - DNA, 36 bp, Homo sapiens
cttctccctggggctgctcctggtgttgcctgctgc

SEQ ID NO: 946 - DNA, 14 bp, Homo sapiens
cttccctgccccag

SEQ ID NO: 947 - DNA, 20 bp, Homo sapiens
acatgtaacaagagtaacat

SEQ ID NO: 948 - DNA, 52 bp, Homo sapiens
gtgtgaaagcagcaaagaggcactggcagaaaacaacctgaaccttccaaag

SEQ ID NO: 949 - DNA, 42 bp, Homo sapiens
atggctgaaaaagatggatgcttccaatctggattcaatgag

SEQ ID NO: 950 - DNA, 108 bp, Homo sapiens
gagacttgcctggtgaaaatcatcactggtcttttggagtttgaggtatacctagagtacctccagaacagatttgagagtagtgaggaacaagccagagctgtgcag

SEQ ID NO: 951 - DNA, 39 bp, Homo sapiens
atgagtacaaaagtcctgatccagttcctgcagaaaaag

SEQ ID NO: 952 - DNA, 34 bp, Homo sapiens
gcaaagaatctagatgcaataaccacccctgacc

SEQ ID NO: 953 - DNA, 44 bp, Homo sapiens
caaccacaaatgccagcctgctgacgaagctgcaggcacagaac

SEQ ID NO: 954 - DNA, 13 bp, Homo sapiens
gtatttatataat

SEQ ID NO: 955 - DNA, 58 bp, Homo sapiens
gtataaatggtttttataccaataaatggcattttaaaaaattcagcaaataagagtg

SEQ ID NO: 956 - protein, 198 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKVGVSSFPQLGVGEDRLKDSVLDNSGMQCHFQKRRLHVNKRV

SEQ ID NO: 957 - protein, 163 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEAKNLDAITTPDPTTNASLLTKLQAQNQWLQDMTTHLILRSFKEFLQSSLRALRQM

SEQ ID NO: 958 - protein, 95 aa, Homo sapiens [sequence omitted]

SEQ ID NO: 959 - protein, 212 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 960 - DNA, 4767 bp, Homo sapiens
  misc_feature (432)..(902): CDS
ggaaacatgattggcagctacgagagagctaggggctggacgtcgaggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggttctcgaggacgagcagcggggtctgccatgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagactttcttatgaagtgagataataagcataaagacaatttctcactgtacagtacaggaagcctttcacagctgacgactcaaatgtctgggtgatttcagagtcttctaaaatgctccagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagca

SEQ ID NO: 961 - DNA, 1447 bp, Homo sapiens
  misc_feature (432)..(962): CDS
ggaaacatgattggcagctacgagagagctaggggctggacgtcgaggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggttctcgaggacgagcagcggggtctgccatgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaaggtgagttttcttctcttaagggtgtgggacctgagatctgtgccaattttttgtatccttggtctgcagtgtcatagagcacattcctcctgtggtggattgcatacagtggattaggagctcattcagctggtggaaagaggggcttggggagtagcagggtttgttctggttctcatcaaatatggttgactggggcaaacattattatttgtctttgacaaatagtttctttcacctagagcagtgtttctcaaagtgcggcctcttgagcagccagcatcagtatcacctgggaacctgttataaatgcagattctcaggccccactaaatgagaaacatagagggtgaaccccagctatctgtattttaacaagccctcccagtaattctgtgcagctaaaatttggtaactattgttctaaagatttggatggggttgtttaatcttggaggaggactttctttataactgatgttgtttcttgtacatagtcccaggatttgtctttagggtacttgtcatcgatcccatttgagagaaacattgcaatacagag

SEQ ID NO: 962 - DNA, 376 bp, Homo sapiens
ggaaacatgattggcagctacgagagagctaggggctggacgtcgaggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaag

SEQ ID NO: 963 - DNA, 149 bp, Homo sapiens
gcgccgtccgctgcgctgggggctcggttctcgaggacgagcagcggggtctgccatgggtcgggggctgctcaggggcctgtggccgctgcacatcgtcctgtggacgcgtatcgccagcacgatcccaccgcacgttcagaagtcgg

SEQ ID NO: 964 - DNA, 169 bp, Homo sapiens
ttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatg

SEQ ID NO: 965 - DNA, 191 bp, Homo sapiens
gagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaag

SEQ ID NO: 966 - DNA, 562 bp, Homo sapiens
gtgagttttcttctcttaagggtgtgggacctgagatctgtgccaattttttgtatccttggtctgcagtgtcatagagcacattcctcctgtggtggattgcatacagtggattaggagctcattcagctggtggaaagaggggcttggggagtagcagggtttgttctggttctcatcaaatatggttgactggggcaaacattattatttgtctttgacaaatagtttctttcacctagagcagtgtttctcaaagtgcggcctcttgagcagccagcatcagtatcacctgggaacctgttataaatgcagattctcaggccccactaaatgagaaacatagagggtgaaccccagctatctgtattttaacaagccctcccagtaattctgtgcagctaaaatttggtaactattgttctaaagatttggatggggttgtttaatcttggaggaggactttctttataactgatgttgtttcttgtacatagtcccaggatttgtctttagggtacttgtcatcgatcccatttgagagaaacattgcaatacagag

SEQ ID NO: 967 - DNA, 124 bp, Homo sapiens
actttcttatgaagtgagataataagcataaagacaatttctcactgtacagtacaggaagcctttcacagctgacgactcaaatgtctgggtgatttcagagtcttctaaaatgctccagaag

SEQ ID NO: 968 - DNA, 800 bp, Homo sapiens
aatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcag

SEQ ID NO: 969 - DNA, 142 bp, Homo sapiens
gtgggaactgcaagatacatggctccagaagtcctagaatccaggatgaatttggagaatgttgagtccttcaagcagaccgatgtctactccatggctctggtgctctgggaaatgacatctcgctgtaatgcagtgggag

SEQ ID NO: 970 - DNA, 128 bp, Homo sapiens
aagtaaaagattatgagcctccatttggttccaaggtgcgggagcacccctgtgtcgaaagcatgaaggacaacgtgttgagagatcgagggcgaccagaaattcccagcttctggctcaaccaccag

SEQ ID NO: 971 - DNA, 2830 bp, Homo sapiens
ggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagcatcctgcctcctgttcccattcctagtagctaaatccatttgcctcatttggttattttgcaatttatgcagaaaacgtcaccaagtaaataatctccaactttttcatactgtctttctcaactgacagtctcacagtcctt

SEQ ID NO: 972 - protein, 176 aa, Homo sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEGEFSSLKGVGPEICANFLYPWSAVS

SEQ ID NO: 973 - protein, 156 aa, Homo sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEDFLMK

SEQ ID NO: 974 - protein, 567 aa, Homo sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENAESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 975 - DNA, 1646 bp, Homo sapiens
  misc_feature (115)..(570): CDS
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcaggtgagccttgttgggcagggtggccaaggtcgtgctggcattctgggcaccacagccgggcctgtgtatgggccctgtccatgctgtcagcccccagcatttcctcatttgtaataacgcccactcagaagggcccaaccactgatcacagctttcccccacagatggaagaactgggaatggcccctgccctgcagcccacccagggtgccatgccggccttcgcctctgctttccagcgccgggcaggaggggtcctagttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaacacat

SEQ ID NO: 976 - DNA, 1907 bp, Homo sapiens
  misc_feature (115)..(447): CDS
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggtgagtgagtgtgccacctacaagctgtgccaccccgaggagctggtgctgctcggacactctctgggcatcccctgggctcccctgagcagctgccccagccaggccctgcagctggtgagtgtcaggaaaggataaggctaatgaggagggggaaggagaggaggaacacccatgggctcccccatgtctccaggttccaagctgggggcctgacgtatctcaggcagcaccccctaactcttccgctctgtctcacaggcaggctgcttgagccaactccatagcggccttttcctctaccaggggctcctgcaggccctggaagggatctcccccgagttgggtcccaccttggacacactgcagctggacgtcgccgactttgccaccaccatctggcagcaggtgagccttgttgggcagggtggccaaggtcgtgctggcattctgggcaccacagccgggcctgtgtatgggccctgtccatgctgtcagcccccagcatttcctcatttgtaataacgcccactcagaagggcccaaccactgatcacagctttcccccacagatggaagaactgggaatggcccctgccctgcagcccacccagggtgccatgccggccttcgcctctgctttccagcgccgggcaggaggggtcctagttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaacacat

SEQ ID NO: 977 - DNA, 1763 bp, Homo sapiens
  misc_feature (115)..(687): CDS
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggtgagtgagtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcaggtgagccttgttgggcagggtggccaaggtcgtgctggcattctgggcaccacagccgggcctgtgtatgggccctgtccatgctgtcagcccccagcatttcctcatttgtaataacgcccactcagaagggcccaaccactgatcacagctttcccccacagatggaagaactgggaatggcccctgccctgcagcccacccagggtgccatgccggccttcgcctctgctttccagcgccgggcaggaggggtcctagttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaacacat

SEQ ID NO: 978 - DNA, 1822 bp, Homo sapiens
  misc_feature (303)..(746): CDS
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatgggtgagtgtcttggcccaggatgggagagccgcctgccctggcatgggagggaggctggtgtgacagaggggctggggatccccgttctgggaatggggattaaaggcacccagtgtccccgagagggcctcaggtggtagggaacagcatgtctcctgagcccgctctgtccccagccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcaggtgagccttgttgggcagggtggccaaggtcgtgctggcattctgggcaccacagccgggcctgtgtatgggccctgtccatgctgtcagcccccagcatttcctcatttgtaataacgcccactcagaagggcccaaccactgatcacagctttcccccacagatggaagaactgggaatggcccctgccctgcagcccacccagggtgccatgccggccttcgcctctgctttccagcgccgggcaggaggggtcctagttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaacacat

SEQ ID NO: 979 - DNA, 1482 bp, Homo sapiens
  misc_feature (115)..(621): CDS
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctagttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaacacat

SEQ ID NO: 980 - DNA, 1491 bp, Homo sapiens
  misc_feature (115)..(630): CDS
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggtgagtgaggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctagttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaacacat

SEQ ID NO: 981 - DNA, 1910 bp, Homo sapiens
  misc_feature (303)..(614): CDS
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatgggtgagtgtcttggcccaggatgggagagccgcctgccctggcatgggagggaggctggtgtgacagaggggctggggatccccgttctgggaatggggattaaaggcacccagtgtccccgagagggcctcaggtggtagggaacagcatgtctcctgagcccgctctgtccccagccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggtgagtgtcaggaaaggataaggctaatgaggagggggaaggagaggaggaacacccatgggctcccccatgtctccaggttccaagctgggggcctgacgtatctcaggcagcaccccctaactcttccgctctgtctcacaggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctagttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaacacat

SEQ ID NO: 982 - DNA, 1655 bp, Homo sapiens
  misc_feature (115)..(579): CDS
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggtgagtgaggcaggctgcttgagccaactccatagcggccttttcctctaccaggggctcctgcaggccctggaagggatctcccccgagttgggtcccaccttggacacactgcagctggacgtcgccgactttgccaccaccatctggcagcaggtgagccttgttgggcagggtggccaaggtcgtgctggcattctgggcaccacagccgggcctgtgtatgggccctgtccatgctgtcagcccccagcatttcctcatttgtaataacgcccactcagaagggcccaaccactgatcacagctttcccccacagatggaagaactgggaatggcccctgccctgcagcccacccagggtgccatgccggccttcgcctctgctttccagcgccgggcaggaggggtcctagttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaacacat

SEQ ID NO: 983 - DNA, 1898 bp, Homo sapiens
  misc_feature (115)..(438): CDS
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggtgagtgtcaggaaaggataaggctaatgaggagggggaaggagaggaggaacacccatgggctcccccatgtctccaggttccaagctgggggcctgacgtatctcaggcagcaccccctaactcttccgctctgtctcacaggcaggctgcttgagccaactccatagcggccttttcctctaccaggggctcctgcaggccctggaagggatctcccccgagttgggtcccaccttggacacactgcagctggacgtcgccgactttgccaccaccatctggcagcaggtgagccttgttgggcagggtggccaaggtcgtgctggcattctgggcaccacagccgggcctgtgtatgggccctgtccatgctgtcagcccccagcatttcctcatttgtaataacgcccactcagaagggcccaaccactgatcacagctttcccccacagatggaagaactgggaatggcccctgccctgcagcccacccagggtgccatgccggccttcgcctctgctttccagcgccgggcaggaggggtcctagttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaacacat

SEQ ID NO: 984 - DNA, 1754 bp, Homo sapiens
  misc_feature (115)..(678): CDS
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcaggtgagccttgttgggcagggtggccaaggtcgtgctggcattctgggcaccacagccgggcctgtgtatgggccctgtccatgctgtcagcccccagcatttcctcatttgtaataacgcccactcagaagggcccaaccactgatcacagctttcccccacagatggaagaactgggaatggcccctgccctgcagcccacccagggtgccatgccggccttcgcctctgctttccagcgccgggcaggaggggtcctagttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaacacat

SEQ ID NO: 985 - DNA, 1831 bp, Homo sapiens
  misc_feature (303)..(755): CDS
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatgggtgagtgtcttggcccaggatgggagagccgcctgccctggcatgggagggaggctggtgtgacagaggggctggggatccccgttctgggaatggggattaaaggcacccagtgtccccgagagggcctcaggtggtagggaacagcatgtctcctgagcccgctctgtccccagccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggtgagtgaggcaggctgcttgagccaactccatagcggccttttcctctaccaggggctcctgcaggccctggaagggatctcccccgagttgggtcccaccttggacacactgcagctggacgtcgccgactttgccaccaccatctggcagcaggtgagccttgttgggcagggtggccaaggtcgtgctggcattctgggcaccacagccgggcctgtgtatgggccctgtccatgctgtcagcccccagcatttcctcatttgtaataacgcccactcagaagggcccaaccactgatcacagctttcccccacagatggaagaactgggaatggcccctgccctgcagcccacccagggtgccatgccggccttcgcctctgctttccagcgccgggcaggaggggtcctagttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaacacat

SEQ ID NO: 986 - DNA, 1491 bp, Homo sapiens; identical to SEQ ID NO: 980
  misc_feature (115)..(630): CDS

SEQ ID NO: 987 - DNA, 1482 bp, Homo sapiens; identical to SEQ ID NO: 979
  misc_feature (115)..(621): CDS

SEQ ID NO: 988 - DNA, 1919 bp, Homo sapiens
  misc_feature (303)..(623): CDS
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatgggtgagtgtcttggcccaggatgggagagccgcctgccctggcatgggagggaggctggtgtgacagaggggctggggatccccgttctgggaatggggattaaaggcacccagtgtccccgagagggcctcaggtggtagggaacagcatgtctcctgagcccgctctgtccccagccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggtgagtgagtgtgccacctacaagctgtgccaccccgaggagctggtgctgctcggacactctctgggcatcccctgggctcccctgagcagctgccccagccaggccctgcagctggtgagtgtcaggaaaggataaggctaatgaggagggggaaggagaggaggaacacccatgggctcccccatgtctccaggttccaagctgggggcctgacgtatctcaggcagcaccccctaactcttccgctctgtctcacaggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctagttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaacacat

SEQ ID NO: 989 - DNA, 154 bp, Homo sapiens
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatgg

SEQ ID NO: 990 - DNA, 176 bp, Homo sapiens
gtgagtgtcttggcccaggatgggagagccgcctgccctggcatgggagggaggctggtgtgacagaggggctggggatccccgttctgggaatggggattaaaggcacccagtgtccccgagagggcctcaggtggtagggaacagcatgtctcctgagcccgctctgtccccag

SEQ ID NO: 991 - DNA, 155 bp, Homo sapiens
ccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctg

SEQ ID NO: 992 - DNA, 144 bp, Homo sapiens
gtgagtgtcaggaaaggataaggctaatgaggagggggaaggagaggaggaacacccatgggctcccccatgtctccaggttccaagctgggggcctgacgtatctcaggcagcaccccctaactcttccgctctgtctcacag

SEQ ID NO: 993 - DNA, 137 bp, Homo sapiens
gcaggctgcttgagccaactccatagcggccttttcctctaccaggggctcctgcaggccctggaagggatctcccccgagttgggtcccaccttggacacactgcagctggacgtcgccgactttgccaccaccat

SEQ ID NO: 994 - DNA, 164 bp, Homo sapiens
gtgagccttgttgggcagggtggccaaggtcgtgctggcattctgggcaccacagccgggcctgtgtatgggccctgtccatgctgtcagcccccagcatttcctcatttgtaataacgcccactcagaagggcccaaccactgatcacagctttcccccacag

SEQ ID NO: 995 - DNA, 918 bp, Homo sapiens
ctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaacacat

SEQ ID NO: 996 - DNA, 9 bp, Homo sapiens
gtgagtgag

SEQ ID NO: 997 - DNA, 108 bp, Homo sapiens
tgtgccacctacaagctgtgccaccccgaggagctggtgctgctcggacactctctgggcatcccctgggctcccctgagcagctgccccagccaggccctgcagctg

SEQ ID NO: 998 - DNA, 10 bp, Homo sapiens
ctggcagcag

SEQ ID NO: 999 - DNA, 108 bp, Homo sapiens
atggaagaactgggaatggcccctgccctgcagcccacccagggtgccatgccggccttcgcctctgctttccagcgccgggcaggaggggtcctagttgcctcccat

SEQ ID NO: 1000 - protein, 151 aa, Homo sapiens
MAGPATQSPMKLMALQLLLWHSALWTVQEATPLGPASSLPQSFLLKCLEQVRKIQGDGAALQEKLAGCLSQLHSGLFLYQGLLQALEGISPELGPTLDTLQLDVADFATTIWQQVSLVGQGGQGRAGILGTTAGPVYGPCPCCQPPAFPHL

SEQ ID NO: 1001 - protein, 110 aa, Homo sapiens
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLVSVRKG

SEQ ID NO: 1002 - protein, 190 aa, Homo sapiens
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQVSLVGQGGQGRAGILGTTAGPVYGPCPCCQPPAFPHL

SEQ ID NO: 1003 - protein, 147 aa, Homo sapiens
MSPEPALSPALQLLLWHSALWTVQEATPLGPASSLPQSFLLKCLEQVRKIQGDGAALQEKLAGCLSQLHSGLFLYQGLLQALEGISPELGPTLDTLQLDVADFATTIWQQVSLVGQGGQGRAGILGTTAGPVYGPCPCCQPPAFPHL

SEQ ID NO: 1004 - protein, 168 aa, Homo sapiens
MAGPATQSPMKLMALQLLLWHSALWTVQEATPLGPASSLPQSFLLKCLEQVRKIQGDGAALQEKLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 1005 - protein, 171 aa, Homo sapiens
MAGPATQSPMKLMALQLLLWHSALWTVQEATPLGPASSLPQSFLLKCLEQVRKIQGDGAALQEKLVSEAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 1006 - protein, 103 aa, Homo sapiens; identical to SEQ ID NO: 1

SEQ ID NO: 1007 - protein, 154 aa, Homo sapiens
MAGPATQSPMKLMALQLLLWHSALWTVQEATPLGPASSLPQSFLLKCLEQVRKIQGDGAALQEKLVSEAGCLSQLHSGLFLYQGLLQALEGISPELGPTLDTLQLDVADFATTIWQQVSLVGQGGQGRAGILGTTAGPVYGPCPCCQPPAFPHL

SEQ ID NO: 1008 - protein, 187 aa, Homo sapiens
MAGPATQSPMKLMALQLLLWHSALWTVQEATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQVSLVGQGGQGRAGILGTTAGPVYGPCPCCQPPAFPHL

SEQ ID NO: 1009 - protein, 150 aa, Homo sapiens
MSPEPALSPALQLLLWHSALWTVQEATPLGPASSLPQSFLLKCLEQVRKIQGDGAALQEKLVSEAGCLSQLHSGLFLYQGLLQALEGISPELGPTLDTLQLDVADFATTIWQQVSLVGQGGQGRAGILGTTAGPVYGPCPCCQPPAFPHL

SEQ ID NO: 1010 - protein, 106 aa, Homo sapiens
MSPEPALSPALQLLLWHSALWTVQEATPLGPASSLPQSFLLKCLEQVRKIQGDGAALQEKLVSECATYKLCHPEELVLLGHSLGIPWAPLSSCPSQALQLVSVRKG

SEQ ID NO: 1011 - protein, 107 aa, Homo sapiens
MAGPATQSPMKLMALQLLLWHSALWTVQEATPLGPASSLPQSFLLKCLEQVRKIQGDGAALQEKLCATYKLCHPEELVLLGHSLGIPWAPLSSCPSQALQLVSVRKG

SEQ ID NO: 1012 - protein, 200 aa, Homo sapiens
MSPEPALSPALQLLLWHSALWTVQEATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 1013 - DNA, 2492 bp, Homo sapiens
  misc_feature (1038)..(1784): CDS
ctgaagggacccccctcggagcccgcccacgcgagatgaggacggtggcccagcccccccatgccctccccctgggggccgcccccgctcccgccccgtgcgcttcctgggtggggccgggggcggcttcaaaaccccctgccgacccagccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacggtgaggcctgcttccccggccatgcccagttgtgacgtgtgtgcgtgtgtgtgttcccatctgccccacgccccacttatctatccctctgagagtgtgtgtgtatgtcccctatcccctgactcccacaccaaagcagggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcg

SEQ ID NO: 1014 - DNA, 2441 bp, Homo sapiens
  misc_feature (1038)..(2129): CDS
ctgaagggacccccctcggagcccgcccacgcgagatgaggacggtggcccagcccccccatgccctccccctgggggccgcccccgctcccgccccgtgcgcttcctgggtggggccgggggcggcttcaaaaccccctgccgacccagccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtacgtctggcccaccgggctacgagatgcgcttggggggagccaggacggaggaagaggagagagaaagagaagtaaagtcagagaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcg

SEQ ID NO: 1015 - DNA, 2317 bp, Homo sapiens
  misc_feature (1038)..(2111): CDS
ctgaagggacccccctcggagcccgcccacgcgagatgaggacggtggcccagcccccccatgccctccccctgggggccgcccccgctcccgccccgtgcgcttcctgggtggggccgggggcggcttcaaaaccccctgccgacccagccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaagctcaatgaacagaacctcatccaggaagtccccaacatctggcaacgtgaagttggctaggaggaaggaagtgccccaaagagaacaagaagaagaggaccctgcattgacgttcctctgggaagcactcatttcctacctttcatttctaagaccgcatgatctgggacatccttcccttcctcgtcggttcgctttattgttcggtcttttaggtcctcgtcagtgggacaaattacaatagctttgcgctggaagccttcaaa

SEQ ID NO: 1016 - DNA, 2466 bp, Homo sapiens
  misc_feature (1038)..(2111): CDS
ctgaagggacccccctcggagcccgcccacgcgagatgaggacggtggcccagcccccccatgccctccccctgggggccgcccccgctcccgccccgtgcgcttcctgggtggggccgggggcggcttcaaaaccccctgccgacccagccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaagctcaatgaacagaacctcatccaggaagtccccaacatctggcaacgtgaagttggctaggaggaaggaagtgccccaaagagaacaagaagaagaggtcagtaccttctgaagtctggtcccctccacccagaagagtggccttccagaagggagaaggtgaagaaaactggaatagtgaataagaaagacatagacagaagggcgggcgcggtggctcacgcctgtaatcccagcactttgggaggccgaggcgggtggatcacctgaggtcaggagttcaagaccagcctggccaacatggcaaaaccccatctctactaaaaatacaaaaattagccaggcatggtggtggacacctgtagtcccagctactcgggaggctgaggcaggagaactgggtgaactcaggagg

SEQ ID NO: 1017 - DNA, 2205 bp, Homo sapiens
  misc_feature (1038)..(2036): CDS
ctgaagggacccccctcggagcccgcccacgcgagatgaggacggtggcccagcccccccatgccctccccctgggggccgcccccgctcccgccccgtgcgcttcctgggtggggccgggggcggcttcaaaaccccctgccgacccagccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcg

SEQ ID NO: 1018 - DNA, 2293 bp, Homo sapiens
  misc_feature (1038)..(2150): CDS
ctgaagggacccccctcggagcccgcccacgcgagatgaggacggtggcccagcccccccatgccctccccctgggggccgcccccgctcccgccccgtgcgcttcctgggtggggccgggggcggcttcaaaaccccctgccgacccagccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtacgtctggcccaccgggctacgagatgcgcttggggggagccaggacggaggaagaggagagagaaagagaagtaaagtcagagaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcg

SEQ ID NO: 1019 - DNA, 334 bp, Homo sapiens
ctgaagggacccccctcggagcccgcccacgcgagatgaggacggtggcccagcccccccatgccctccccctgggggccgcccccgctcccgccccgtgcgcttcctgggtggggccgggggcggcttcaaaaccccctgccgacccagccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgag

SEQ ID NO: 1020 - DNA, 247 bp, Homo sapiens
gagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaaga

SEQ ID NO: 1021 - DNA, 234 bp, Homo sapiens
cttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcc

SEQ ID NO: 1022 - DNA, 213 bp, Homo sapiens
cttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggc

SEQ ID NO: 1023 - DNA, 173 bp, Homo sapiens
ccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacg

SEQ ID NO: 1024 - DNA, 161 bp, Homo sapiens
aaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccag

SEQ ID NO: 1025 - DNA, 139 bp, Homo sapiens
gtgaggcctgcttccccggccatgcccagttgtgacgtgtgtgcgtgtgtgtgttcccatctgccccacgccccacttatctatccctctgagagtgtgtgtgtatgtcccctatcccctgactcccacaccaaagcag

SEQ ID NO: 1026 - DNA, 154 bp, Homo sapiens
ctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaag

SEQ ID NO: 1027 - DNA, 132 bp, Homo sapiens
cggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgc

SEQ ID NO: 1028 - DNA, 835 bp, Homo sapiens
cccgccccgcccccgctgccttgcccatgggggctgtatttaaggacacccgtgccccaagcccacctggggccccattaaagatggagagaggactgcggatctctgtgtcattgggcgcctgcctggggtctccatccctgacgttcccccactcccactccctctctctccctctctgcctcctcctgcctgtctgcactattcctttgcccggcatcaaggcacaggggaccagtggggaacactactgtagttagatctatttattgagcaccttgggcactgttgaagtgccttacattaatgaactcattcagtcaccatagcaacactctgagatggcagggactctgataacacccattttaaaggtgaggaaacaagcccagagaggttaagggaggagttcctgcccaccaggaacctgctttagtgggggatagtgaagaagacaataaaagatagtagttcaggccaggcggggtggctcacgcctgtaatcctagcacttttgggaggcagagatgggaggattacttgaatccaggcatttgagaccagcctgggtaacatagtgagaccctatctctacaaaacacttttaaaaaatgtacacctgtggtcccagctactctggaggctaaggtgggaggatcacttgatcctgggaggtcaaggctgcagtgagccctgactgtgccactgtatgccagcctgggtgacaaagcaagactccatcttttttttatgttttttttttgagacggattttcactcttgttgcccaggctggagtgcaatgtcgagatcttggctcaccacaacctctgcc

SEQ ID NO: 1029 - DNA, 318 bp, Homo sapiens
gtcagtaccttctgaagtctggtcccctccacccagaagagtggccttccagaagggagaaggtgaagaaaactggaatagtgaataagaaagacatagacagaagggcgggcgcggtggctcacgcctgtaatcccagcactttgggaggccgaggcgggtggatcacctgaggtcaggagttcaagaccagcctggccaacatggcaaaaccccatctctactaaaaatacaaaaattagccaggcatggtggtggacacctgtagtcccagctactcgggaggctgaggcaggagaactgggtgaactcaggagg

SEQ ID NO: 1030 - DNA, 169 bp, Homo sapiens
gaccctgcattgacgttcctctgggaagcactcatttcctacctttcatttctaagaccgcatgatctgggacatccttcccttcctcgtcggttcgctttattgttcggtcttttaggtcctcgtcagtgggacaaattacaatagctttgcgctggaagccttcaaa

SEQ ID NO: 1031 - DNA, 81 bp, Homo sapiens
gagcagcctgaggccccagagtctgagacgagccgccgccgcccccgccactgcggggaggagggggaggaggagcgggag

SEQ ID NO: 1032 - DNA, 110 bp, Homo sapiens
cggccggccgcgggactatccacctgcaagactatcgacatggagctggtgaagcggaagcgcatcgaggccatccgcggccagatcctgtccaagctgcggctcgccag

SEQ ID NO: 1033 - DNA, 118 bp, Homo sapiens
aaatacagcaacaattcctggcgatacctcagcaaccggctgctggcacccagcgactcgccagagtggttatcttttgatgtcaccggagttgtgcggcagtggttgagccgtggag

SEQ ID NO: 1034 - DNA, 78 bp, Homo sapiens
gggaaattgagggctttcgccttagcgcccactgctcctgtgacagcagggataacacactgcaagtggacatcaacg

SEQ ID NO: 1035 - DNA, 59 bp, Homo sapiens
ggttcactaccggccgccgaggtgacctggccaccattcatggcatgaaccggcctttc

SEQ ID NO: 1036 - DNA, 39 bp, Homo sapiens
ctgcttctcatggccaccccgctggagagggcccagcat

SEQ ID NO: 1037 - DNA, 12 bp, Homo sapiens
ctgcaaagctcc

SEQ ID NO: 1038 - DNA, 38 bp, Homo sapiens
cggcaccgccgagccctggacaccaactattgcttcag

SEQ ID NO: 1039 - DNA, 88 bp, Homo sapiens
gtacgtctggcccaccgggctacgagatgcgcttggggggagccaggacggaggaagaggagagagaaagagaagtaaagtcagagag

SEQ ID NO: 1040 - DNA, 40 bp, Homo sapiens
gtcctggccctgtacaaccagcataacccgggcgcctcgg

SEQ ID NO: 1041 - DNA, 30 bp, Homo sapiens
cccgccccgccccggcaggcccggccccac

SEQ ID NO: 1042 - DNA, 97 bp, Homo sapiens
ctcaatgaacagaacctcatccaggaagtccccaacatctggcaacgtgaagttggctaggaggaaggaagtgccccaaagagaacaagaagaagag

SEQ ID NO: 1043 - protein, 248 aa, Homo sapiens [sequence omitted]

SEQ ID NO: 1044 - protein, 363 aa, Homo sapiens [sequence omitted]

SEQ ID NO: 1045 - protein, 357 aa, Homo sapiens
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKLNEQNLIQEVPNIWQREVG

SEQ ID NO: 1046 - protein, 332 aa, Homo sapiens [sequence omitted]

SEQ ID NO: 1047 - protein, 370 aa, Homo sapiens
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINAPRRRTAACGSCTLTSARTSAGSGSTSPRATMPTSASGPAPTFGAWTRSTARYVWPTGLRDALGGSQDGGRGERKRSKVREVLALYNQHNPGASAAPCCVPQALEPLPIVYYVGRKPKVEQLSNMIVRSCKCS

SEQ ID NO: 1048 - protein, 390 aa, Homo sapiens
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 1049 - DNA, 2441 bp, Homo sapiens
  misc_feature (236)..(1684): CDS
aaaaacaggcctgcctcagctccctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcactacaggggcacgtggagcacagcggagagtggcgccgagtgcaccaactggaacagcagcgcgttggcccagaagccctacagcgggcggaggccagatgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 1050 - DNA, 2294 bp, Homo sapiens
  misc_feature (236)..(1537): CDS
aaaaacaggcctgcctcagctccctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcgaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 1051 - DNA, 2105 bp, Homo sapiens
  misc_feature (236)..(1348): CDS
aaaaacaggcctgcctcagctccctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaaggttgcagcgagccaaggtgtttcaacgggggcacctgccagcaggccctgtacttctcagatttcgtgtgccatgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 1052 - DNA, 178 bp, Homo sapiens
aaaaacaggcctgcctcagctccctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaac

SEQ ID NO: 1053 - DNA, 167 bp, Homo sapiens
tgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccag

SEQ ID NO: 1054 - DNA, 443 bp, Homo sapiens
ctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaa

SEQ ID NO: 1055 - DNA, 128 bp, Homo sapiens
ctcaatagtaaaagataacaagatctttcaggaaagacggattgcattagaaatagacagtatatttatagtcacaagagcccagcagggcctcaaagttggggcaggctggctggcccgtcatgttc

SEQ ID NO: 1056 - DNA, 877 bp, Homo sapiens
ctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaaaaagagtggaatggttttgttatagatgctgtatcccactctttattcatgttcacattttaaaatcatttggaattctgcttcactcgcttaacatatacacaacacctgtaacatacaaggcaatgggctaggtgctccagaccgggaaaaggagggacaggaatgcttggtctgatgggctaatatggcatttagagaagtaccaaggtacagtggagccggtcacaaaagggcagacttgtagtagaattcagttgcaagagggattggggaatcttaaggaaaaaatagaatcttaaggaaaaaataactgggtgagacgtggactgtggacaggtgtggaaaaggcactctccatggaggtatgaatatgtagagggccaagagaggggagtacagggagaaatgagttgagcttgtctgaagtgaacttcaggaagaggaacataggctggaatttagattatgggggctctgaacaccaaactgagtttggacttaattgacttctgtaggcaacgaggagccatggagattctgctcagggaagtgaggaactgggcatgccttaggaaaattaaccagggggtggctggcaagcaagcagaca

SEQ ID NO: 1057 - DNA, 31 bp, Homo sapiens
ctctgcgaggaaagggaaggagcaagccgtg

SEQ ID NO: 1058 - DNA, 98 bp, Homo sapiens
aatttaagggacgctgtgaagcaatcatggatgcaatgaagagagggctctgctgtgtgctgctgctgtgtggagcagtcttcgtttcgcccagccag

SEQ ID NO: 1059 - DNA, 22 bp, Homo sapiens
gaaatccatgcccgattcagaa

SEQ ID NO: 1060 - DNA, 12 bp, Homo sapiens
gaggagccagat

SEQ ID NO: 1061 - DNA, 9 bp, Homo sapiens
cttaccaag

SEQ ID NO: 1062 - DNA, 19 bp, Homo sapiens
tgatctgcagagatgaaaa

SEQ ID NO: 1063 - DNA, 27 bp, Homo sapiens
aacgcagatgatataccagcaacatca

SEQ ID NO: 1064 - DNA, 45 bp, Homo sapiens
gtcatggctgcgccctgtgctcagaagcaaccgggtggaatattg

SEQ ID NO: 1065 - DNA, 38 bp, Homo sapiens
ctggtgcaacagtggcagggcacagtgccactcagtgc

SEQ ID NO: 1066 - DNA, 47 bp, Homo sapiens
gttgcagcgagccaaggtgtttcaacgggggcacctgccagcaggcc

SEQ ID NO: 1067 - DNA, 5 bp, Homo sapiens
ctgta

SEQ ID NO: 1068 - DNA, 8 bp, Homo sapiens
cttctcag

SEQ ID NO: 1069 - DNA, 13 bp, Homo sapiens
atttcgtgtgcca

SEQ ID NO: 1070 - DNA, 8 bp, Homo sapiens
ctacaggg

SEQ ID NO: 1071 - DNA, 4 bp, Homo sapiens
gcac

SEQ ID NO: 1072 - DNA, 61 bp, Homo sapiens
gtggagcacagcggagagtggcgccgagtgcaccaactggaacagcagcgcgttggcccag

SEQ ID NO: 1073 - DNA, 42 bp, Homo sapiens
aagccctacagcgggcggaggccagatgccatcaggctgggc

SEQ ID NO: 1074 - DNA, 23 bp, Homo sapiens
ctggggaaccacaactactgcag

SEQ ID NO: 1075 - DNA, 92 bp, Homo sapiens
aaacccagatcgagactcaaagccctggtgctacgtctttaaggcggggaagtacagctcagagttctgcagcacccctgcctgctctgagg

SEQ ID NO: 1076 - DNA, 23 bp, Homo sapiens
gaaacagtgactgctactttggg

SEQ ID NO: 1077 - DNA, 78 bp, Homo sapiens
aatgggtcagcctaccgtggcacgcacagcctcaccgagtcgggtgcctcctgcctcccgtggaattccatgatcctg

SEQ ID NO: 1078 - DNA, 4 bp, Homo sapiens
atag

SEQ ID NO: 1079 - DNA, 5 bp, Homo sapiens
gcaag

SEQ ID NO: 1080 - DNA, 15 bp, Homo sapiens
gtttacacagcacag

SEQ ID NO: 1081 - DNA, 8 bp, Homo sapiens
aaccccag

SEQ ID NO: 1082 - DNA, 16 bp, Homo sapiens
tgcccaggcactgggc

SEQ ID NO: 1083 - DNA, 17 bp, Homo sapiens
ctgggcaaacataatta

SEQ ID NO: 1084 - DNA, 6 bp, Homo sapiens
ctgccg

SEQ ID NO: 1085 - DNA, 24 bp, Homo sapiens
gaatcctgatggggatgccaagcc

SEQ ID NO: 1086 - DNA, 7 bp, Homo sapiens
ctggtgc

SEQ ID NO: 1087 - DNA, 55 bp, Homo sapiens
cacgtgctgaagaaccgcaggctgacgtgggagtactgtgatgtgccctcctgct

SEQ ID NO: 1088 - DNA, 14 bp, Homo sapiens
ccacctgcggcctg

SEQ ID NO: 1089 - DNA, 37 bp, Homo sapiens
agacagtacagccagcctcagtttcgcatcaaaggag

SEQ ID NO: 1090 - DNA, 43 bp, Homo sapiens
ggctcttcgccgacatcgcctcccacccctggcaggctgccat

SEQ ID NO: 1091 - DNA, 97 bp, Homo sapiens
ctttgccaagcacaggaggtcgcccggagagcggttcctgtgcgggggcatactcatcagctcctgctggattctctctgccgcccactgcttccag

SEQ ID NO: 1092 - DNA, 5 bp, Homo sapiens
gagag

SEQ ID NO: 1093 - DNA, 70 bp, Homo sapiens
gtttccgccccaccacctgacggtgatcttgggcagaacataccgggtggtccctggcgaggaggagcag

SEQ ID NO: 1094 - DNA, 67 bp, Homo sapiens
aaatttgaagtcgaaaaatacattgtccataaggaattcgatgatgacacttacgacaatgacattg

SEQ ID NO: 1095 - DNA, 31 bp, Homo sapiens
cgctgctgcagctgaaatcggattcgtcccg

SEQ ID NO: 1096 - DNA, 58 bp, Homo sapiens
ctgtgcccaggagagcagcgtggtccgcactgtgtgccttcccccggcggacctgcag

SEQ ID NO: 1097 - DNA, 52 bp, Homo sapiens
ctgccggactggacggagtgtgagctctccggctacggcaagcatgaggcct

SEQ ID NO: 1098 - DNA, 18 bp, Homo sapiens
ggcgattcgggaggcccc

SEQ ID NO: 1099 - DNA, 47 bp, Homo sapiens
ctggtgtgtctgaacgatggccgcatgactttggtgggcatcatcag

SEQ ID NO: 1100 - DNA, 7 bp, Homo sapiens
ctggggc

SEQ ID NO: 1101 - DNA, 12 bp, Homo sapiens
atgaaagcatgt

SEQ ID NO: 1102 - protein, 482 aa, Homo sapiens [sequence omitted]

SEQ ID NO: 1103 - protein, 433 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVRNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 1104 - protein, 370 aa, Homo sapiens
MDAMKRGLCCVLLLCGAVFVSPSQEIHARFRRGARSYQGCSEPRCFNGGTCQQALYFSDFVCHAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 1105 - DNA, 1969 bp, Homo sapiens
  misc_feature (1181)..(1822): CDS
ccatagtcttagctactcaggaggctgaggagggaggattatctgagccctggcggttgaggctataatgagccatgattgtgccactgcactccagccttggcaacacagtgtgagaccctgtctcaaaaacaataaaaacccaaaacaaaagaaccaagaaattactggacctgaggcctggcctttagctgctgccctgcccttgtgacctggtcactcgggatcccctgggcctaaacacacagcctattgtctacctcaagaaggctccccactgcttggctggcaattggggtgggctttgcaggccccacctgtcctggccccacggcgctggtgctgcaggcccccaccactgcttgttccgagctccccagcctcctgcagagttgcctgcacctgatggcgatgaatcaggaaggcaggcgtgtcctgggccacagagcagtcatggctgtcagccaccagggggctccatttgcaactttggatgtggctttggcctctttgtccaaagtgaccttggggcccccagacaagagacagggagactggagcccagccccaccctcccgcacatacctggcccatccctgccctatcctggaagatgggggccaccacacgtgcaagggacacgggataggaacctttggccttgttatcagacattttaaaactaagtgcaaacgtgattatcaggtgcagtttttacagcagcaagaaacctgtgcttacagaaagaaacacgtgctagcaacccacctatgcggaaagccacacagagccattgttttctgcactctcaggtgacggctcacatttgccccagggaaggtcacagctgcctgaacttttaaaactcccagacacgcactgcctgtgcaggatccggagcccagcagcactgccagggccttgaagtgcttcttcagagacctttcttcatagactacttttttttctttaagcagcaaaaggagaaaattgtcatcaaaggatattccagattcttgacagcattctcgtcatctctgaggacatcaccatcatctcaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcagggatgcaccagacacctatcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacagaggtcagggagtttgccattgttcccctgcatgcggccccgggggacgcagtagccgagatcgacgctctctatgacgtctacctggatgtccaagagaaatggggcttggaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggatcgtggttgcagggatgctgctccgaggcgccgttgttcccgactcggctcttccctttaacttccaggctgcctatggcctgagtgaccaactggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtcatctgt

SEQ ID NO: 1106 - DNA, 2147 bp, Homo sapiens
  misc_feature (1063)..(1893): CDS
ccatagtcttagctactcaggaggctgaggagggaggattatctgagccctggcggttgaggctataatgagccatgattgtgccactgcactccagccttggcaacacagtgtgagaccctgtctcaaaaacaataaaaacccaaaacaaaagaaccaagaaattactggacctgaggcctggcctttagctgctgccctgcccttgtgacctggtcactcgggatcccctgggcctaaacacacagcctattgtctacctcaagaaggctccccactgcttggctggcaattggggtgggctttgcaggccccacctgtcctggccccacggcgctggtgctgcaggcccccaccactgcttgttccgagctccccagcctcctgcagagttgcctgcacctgatggcgatgaatcaggaaggcaggcgtgtcctgggccacagagcagtcatggctgtcagccaccagggggctccatttgcaactttggatgtggctttggcctctttgtccaaagtgaccttggggcccccagacaagagacagggagactggagcccagccccaccctcccgcacatacctggcccatccctgccctatcctggaagatgggggccaccacacgtgcaagggacacgggataggaacctttggccttgttatcagacattttaaaactaagtgcaaacgtgattatcaggtgcagtttttacagcagcaagaaacctgtgcttacagaaagaaacacgtgctagcaacccacctatgcggaaagccacacagagccattgttttctgcactctcaggtgacggctcacatttgccccagggaaggtcacagctgcctgaacttttaaaactcccagacacgcactgcctgtgcaggatccggagcccagcagcactgccagggccttgaagtgcttcttcagagacctttcttcatagactacttttttttctttaagcagcaaaaggagaaaattgtcatcaaaggatattccagattcttgacagcattctcgtcatctctgaggacatcaccatcatctcaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcagatcctgagccgctatgacatcgccctggtccaggaggtcagagacagccacctgactgccgtggggaagctgctggacaacctcaatcaggatgcaccagacacctatcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacagaggtcagggagtttgccattgttcccctgcatgcggccccgggggacgcagtagccgagatcgacgctctctatgacgtctacctggatgtccaagagaaatggggcttggaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggatcgtggttgcagggatgctgctccgaggcgccgttgttcccgactcggctcttccctttaacttccaggctgcctatggcctgagtgaccaactggtatgtgtcctcccttgcacagccacatgaggatgggacacaggagctcaggtaggctcagcccagaccctgtgcccacttgcctgcaggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtcatctgt

SEQ ID NO: 1107 - DNA, 1988 bp, Homo sapiens
  misc_feature (1063)..(1782): CDS
ccatagtcttagctactcaggaggctgaggagggaggattatctgagccctggcggttgaggctataatgagccatgattgtgccactgcactccagccttggcaacacagtgtgagaccctgtctcaaaaacaataaaaacccaaaacaaaagaaccaagaaattactggacctgaggcctggcctttagctgctgccctgcccttgtgacctggtcactcgggatcccctgggcctaaacacacagcctattgtctacctcaagaaggctccccactgcttggctggcaattggggtgggctttgcaggccccacctgtcctggccccacggcgctggtgctgcaggcccccaccactgcttgttccgagctccccagcctcctgcagagttgcctgcacctgatggcgatgaatcaggaaggcaggcgtgtcctgggccacagagcagtcatggctgtcagccaccagggggctccatttgcaactttggatgtggctttggcctctttgtccaaagtgaccttggggcccccagacaagagacagggagactggagcccagccccaccctcccgcacatacctggcccatccctgccctatcctggaagatgggggccaccacacgtgcaagggacacgggataggaacctttggccttgttatcagacattttaaaactaagtgcaaacgtgattatcaggtgcagtttttacagcagcaagaaacctgtgcttacagaaagaaacacgtgctagcaacccacctatgcggaaagccacacagagccattgttttctgcactctcaggtgacggctcacatttgccccagggaaggtcacagctgcctgaacttttaaaactcccagacacgcactgcctgtgcaggatccggagcccagcagcactgccagggccttgaagtgcttcttcagagacctttcttcatagactacttttttttctttaagcagcaaaaggagaaaattgtcatcaaaggatattccagattcttgacagcattctcgtcatctctgaggacatcaccatcatctcaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcagatcctgagccgctatgacatcgccctggtccaggaggtcagagacagccacctgactgccgtggggaagctgctggacaacctcaatcaggatgcaccagacacctatcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacagaggtcagggagtttgccattgttcccctgcatgcggccccgggggacgcagtagccgagatcgacgctctctatgacgtctacctggatgtccaagagaaatggggcttggaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggctgcctatggcctgagtgaccaactggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtcatctgt

SEQ ID NO: 1108 - DNA, 2475 bp, Homo sapiens
  misc_feature (1391)..(2221): CDS
ccatagtcttagctactcaggaggctgaggagggaggattatctgagccctggcggttgaggctataatgagccatgattgtgccactgcactccagccttggcaacacagtgtgagaccctgtctcaaaaacaataaaaacccaaaacaaaagaaccaagaaattactggacctgaggcctggcctttagctgctgccctgcccttgtgacctggtcactcgggatcccctgggcctaaacacacagcctattgtctacctcaagaaggctccccactgcttggctggcaattggggtgggctttgcaggccccacctgtcctggccccacggcgctggtgctgcaggcccccaccactgcttgttccgagctccccagcctcctgcagagttgcctgcacctgatggcgatgaatcaggaaggcaggcgtgtcctgggccacagagcagtcatggctgtcagccaccagggggctccatttgcaactttggatgtggctttggcctctttgtccaaagtgaccttggggcccccagacaagagacagggagactggagcccagccccaccctcccgcacatacctggcccatccctgccctatcctggaagatgggggccaccacacgtgcaagggacacgggataggaacctttggccttgttatcagacattttaaaactaagtgcaaacgtgattatcaggtgcagtttttacagcagcaagaaacctgtgcttacagaaagaaacacgtgctagcaacccacctatgcggaaagccacacagagccattgttttctgcactctcaggtgacggctcacatttgccccagggaaggtcacagctgcctgaacttttaaaactcccagacacgcactgcctgtgcaggatccggagcccagcagcactgccagggccttgaagtgcttcttcagagacctttcttcatagactacttttttttctttaagcagcaaaaggagaaaattgtcatcaaaggatattccagattcttgacagcattctcgtcatctctgaggacatcaccatcatctcaggtgagcaccaggtggagtgcctctgggtgactggccggtttggagcagggagggaggcttagagtctcatcctccagcagcgagtgaggcggaggctccagcgtccctcccgggcgggttttctggtggatggaggagtgactcggggtcctctacgtggtgccagctgtttggctttctggacgttgtaggaaagggtttcccccgcctgcgtccccctgaccttgagctccaccagcccctgccagctgggctccagaaggctggagtgctgtggcagggatgacgtctcacttctgttatgtctctgtgccctgtgctctcccaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcagatcctgagccgctatgacatcgccctggtccaggaggtcagagacagccacctgactgccgtggggaagctgctggacaacctcaatcaggatgcaccagacacctatcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacagaggtcagggagtttgccattgttcccctgcatgcggccccgggggacgcagtagccgagatcgacgctctctatgacgtctacctggatgtccaagagaaatggggcttggaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggatcgtggttgcagggatgctgctccgaggcgccgttgttcccgactcggctcttccctttaacttccaggctgcctatggcctgagtgaccaactggtatgtgtcctcccttgcacagccacatgaggatgggacacaggagctcaggtaggctcagcccagaccctgtgcccacttgcctgcaggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtcatctgt

SEQ ID NO: 1109 - DNA, 1970 bp, Homo sapiens
  misc_feature (1063)..(1536): CDS
ccatagtcttagctactcaggaggctgaggagggaggattatctgagccctggcggttgaggctataatgagccatgattgtgccactgcactccagccttggcaacacagtgtgagaccctgtctcaaaaacaataaaaacccaaaacaaaagaaccaagaaattactggacctgaggcctggcctttagctgctgccctgcccttgtgacctggtcactcgggatcccctgggcctaaacacacagcctattgtctacctcaagaaggctccccactgcttggctggcaattggggtgggctttgcaggccccacctgtcctggccccacggcgctggtgctgcaggcccccaccactgcttgttccgagctccccagcctcctgcagagttgcctgcacctgatggcgatgaatcaggaaggcaggcgtgtcctgggccacagagcagtcatggctgtcagccaccagggggctccatttgcaactttggatgtggctttggcctctttgtccaaagtgaccttggggcccccagacaagagacagggagactggagcccagccccaccctcccgcacatacctggcccatccctgccctatcctggaagatgggggccaccacacgtgcaagggacacgggataggaacctttggccttgttatcagacattttaaaactaagtgcaaacgtgattatcaggtgcagtttttacagcagcaagaaacctgtgcttacagaaagaaacacgtgctagcaacccacctatgcggaaagccacacagagccattgttttctgcactctcaggtgacggctcacatttgccccagggaaggtcacagctgcctgaacttttaaaactcccagacacgcactgcctgtgcaggatccggagcccagcagcactgccagggccttgaagtgcttcttcagagacctttcttcatagactacttttttttctttaagcagcaaaaggagaaaattgtcatcaaaggatattccagattcttgacagcattctcgtcatctctgaggacatcaccatcatctcaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcagatcctgagccgctatgacatcgccctggtccaggaggtcagagacagccacctgactgccgtggggaagctgctggacaacctcaatcaggatgcaccagacacctatcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacagggccacaggcagcgtttcctggtaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggatcgtggttgcagggatgctgctccgaggcgccgttgttcccgactcggctcttccctttaacttccaggctgcctatggcctgagtgaccaactggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtcatctgt

SEQ ID NO: 1110 - DNA, 812 bp, Homo sapiens
ccatagtcttagctactcaggaggctgaggagggaggattatctgagccctggcggttgaggctataatgagccatgattgtgccactgcactccagccttggcaacacagtgtgagaccctgtctcaaaaacaataaaaacccaaaacaaaagaaccaagaaattactggacctgaggcctggcctttagctgctgccctgcccttgtgacctggtcactcgggatcccctgggcctaaacacacagcctattgtctacctcaagaaggctccccactgcttggctggcaattggggtgggctttgcaggccccacctgtcctggccccacggcgctggtgctgcaggcccccaccactgcttgttccgagctccccagcctcctgcagagttgcctgcacctgatggcgatgaatcaggaaggcaggcgtgtcctgggccacagagcagtcatggctgtcagccaccagggggctccatttgcaactttggatgtggctttggcctctttgtccaaagtgaccttggggcccccagacaagagacagggagactggagcccagccccaccctcccgcacatacctggcccatccctgccctatcctggaagatgggggccaccacacgtgcaagggacacgggataggaacctttggccttgttatcagacattttaaaactaagtgcaaacgtgattatcaggtgcagtttttacagcagcaagaaacctgtgcttacagaaagaaacacgtgctagcaacccacctatgcggaaagccacacagagccattgttttctgcactctcag

SEQ ID NO: 1111 - DNA, 165 bp, Homo sapiens
gtgacggctcacatttgccccagggaaggtcacagctgcctgaacttttaaaactcccagacacgcactgcctgtgcaggatccggagcccagcagcactgccagggccttgaagtgcttcttcagagacctttcttcatagactacttttttttctttaagcag

SEQ ID NO: 1112 - DNA, 323 bp, Homo sapiens
caccaggtggagtgcctctgggtgactggccggtttggagcagggagggaggcttagagtctcatcctccagcagcgagtgaggcggaggctccagcgtccctcccgggcgggttttctggtggatggaggagtgactcggggtcctctacgtggtgccagctgtttggctttctggacgttgtaggaaagggtttcccccgcctgcgtccccctgaccttgagctccaccagcccctgccagctgggctccagaaggctggagtgctgtggcagggatgacgtctcacttctgttatgtctctgtgccctgtgctctcccag

SEQ ID NO: 1113 - DNA, 148 bp, Homo sapiens
gatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcag

SEQ ID NO: 1114 - DNA, 195 bp, Homo sapiens
gcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtcatctgt

SEQ ID NO: 1115 - DNA, 84 bp, Homo sapiens
caaaaggagaaaattgtcatcaaaggatattccagattcttgacagcattctcgtcatctctgaggacatcaccatcatctcag

SEQ ID NO: 1116 - DNA, 5 bp, Homo sapiens
gtgag

SEQ ID NO: 1117 - DNA, 89 bp, Homo sapiens
atcctgagccgctatgacatcgccctggtccaggaggtcagagacagccacctgactgccgtggggaagctgctggacaacctcaatca

SEQ ID NO: 1118 - DNA, 84 bp, Homo sapiens
ggatgcaccagacacctatcactacgtggtcagtgagccactgggacggaacagctataaggagcgctacctgttcgtgtacag

SEQ ID NO: 1119 - DNA, 116 bp, Homo sapiens
gcctgaccaggtgtctgcggtggacagctactactacgatgatggctgcgagccctgcgggaacgacaccttcaaccgagagccagccattgtcaggttcttctcccggttcacag

SEQ ID NO: 1120 - DNA, 113 bp, Homo sapiens
aggtcagggagtttgccattgttcccctgcatgcggccccgggggacgcagtagccgagatcgacgctctctatgacgtctacctggatgtccaagagaaatggggcttggag

SEQ ID NO: 1121 - DNA, 25 bp, Homo sapiens
ggccacaggcagcgtttcctggtag

SEQ ID NO: 1122 - DNA, 38 bp, Homo sapiens
gacgtcatgttgatgggcgacttcaatgcgggctgcag

SEQ ID NO: 1123 - DNA, 117 bp, Homo sapiens
ctatgtgagaccctcccagtggtcatccatccgcctgtggacaagccccaccttccagtggctgatccccgacagcgctgacaccacagctacacccacgcactgtgcctatgacag

SEQ ID NO: 1124 - DNA, 70 bp, Homo sapiens
gatcgtggttgcagggatgctgctccgaggcgccgttgttcccgactcggctcttccctttaacttccag

SEQ ID NO: 1125 - DNA, 27 bp, Homo sapiens
gctgcctatggcctgagtgaccaactg

SEQ ID NO: 1126 - DNA, 89 bp, Homo sapiens
gtatgtgtcctcccttgcacagccacatgaggatgggacacaggagctcaggtaggctcagcccagaccctgtgcccacttgcctgcag

SEQ ID NO: 1127 - protein, 213 aa, Homo sapiens
MPPSSATLCRDAPDTYHYVVSEPLGRNSYKERYLFVYRPDQVSAVDSYYYDDGCEPCGNDTFNREPAIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 1128 - protein, 276 aa, Homo sapiens
MRGMKLLGALLALAALLQGAVSLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPAIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLVCVLPCTAT

SEQ ID NO: 1129 - protein, 239 aa, Homo sapiens
MRGMKLLGALLALAALLQGAVSLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPAIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRLPMA

SEQ ID NO: 1130 - protein, 157 aa, Homo sapiens
MRGMKLLGALLALAALLQGAVSLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPAIVRFFSRFTGPQAAFPGRTSC

SEQ ID NO: 1131 - protein, 282 aa, Homo sapiens [sequence omitted]

SEQ ID NO: 1132 - DNA, 2772 bp, Homo sapiens
  misc_feature (178)..(609): CDS
agcagacgctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagaggtgagtgcctggccagccttcatccactctcccacccaaggggaaatggagacgcaagagagggagagagatgggatgggtgaaagatgtgcgctgatagggagggatggagagaaaaaaacgtggagaaagacggggatgcagaaagagatgtggcaagagatggggaagagagagagagaaagatggagagacaggatgtctggcacatggaaggtgctcactaagtgtgtatggagtgaatgaatgaatgaatgaatgaacaagcagatatataaataagatatggagacagatgtggggtgtgagaagagagatgggggaagaaacaagtgatatgaataaagatggtgagacagaaagagcgggaaatatgacagctaaggagagagatgggggagataaggagagaagaagatagggtgtctggcacacagaagacactcagggaaagagctgttgaatgcctggaaggtgaatacacagatgaatggagagagaaaaccagacacctcagggctaagagcgcaggccagacaggcagccagctgttcctcctttaagggtgactccctcgatgttaaccattctccttctccccaacagttccccagggacctctctctaatcagccctctggcccaggcagtcagtaagtgtctccaaacctctttcctaattctgggtttgggtttgggggtagggttagtaccggtatggaagcagtgggggaaatttaaagttttggtcttgggggaggatggatggaggtgaaagtaggggggtattttctaggaagtttaagggtctcagctttttcttttctctctcctcttcaggatcatcttctcgaaccccgagtgacaagcctgtagcccatgttgtaggtaagagctctgaggatgtgtcttggaacttggagggctaggatttggggattgaagcccggctgatggtaggcagaacttggagacaatgtgagaaggactcgctgagctcaagggaagggtggaggaacagcacaggccttagtgggatactcagaacgtcatggccaggtgggatgtgggatgacagacagagaggacaggaaccggatgtggggtgggcagagctcgagggccaggatgtggagagtgaaccgacatggccacactgactctcctctccctctctccctccctccagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaa

SEQ ID NO: 1133 - DNA, 1584 bp, Homo sapiens
  misc_feature (178)..(399): CDS
agcagacgctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaa

SEQ ID NO: 1134 - DNA, 1630 bp, Homo sapiens
  misc_feature (178)..(831): CDS
agcagacgctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcacaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaa

SEQ ID NO: 1135 - DNA, 229 bp, Homo sapiens
agcagacgctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctcc

SEQ ID NO: 1136 - DNA, 134 bp, Homo sapiens
ccaagaagacaggggggccccagggctccaggcggtgcttgttcctcagcctcttctccttcctgatcgtggcaggcgccaccacgctcttctgcctgctgcactttggagtgatcggcccccagagggaagag

SEQ ID NO: 1137 - DNA, 606 bp, Homo sapiens
gtgagtgcctggccagccttcatccactctcccacccaaggggaaatggagacgcaagagagggagagagatgggatgggtgaaagatgtgcgctgatagggagggatggagagaaaaaaacgtggagaaagacggggatgcagaaagagatgtggcaagagatggggaagagagagagagaaagatggagagacaggatgtctggcacatggaaggtgctcactaagtgtgtatggagtgaatgaatgaatgaatgaatgaacaagcagatatataaataagatatggagacagatgtggggtgtgagaagagagatgggggaagaaacaagtgatatgaataaagatggtgagacagaaagagcgggaaatatgacagctaaggagagagatgggggagataaggagagaagaagatagggtgtctggcacacagaagacactcagggaaagagctgttgaatgcctggaaggtgaatacacagatgaatggagagagaaaaccagacacctcagggctaagagcgcaggccagacaggcagccagctgttcctcctttaagggtgactccctcgatgttaaccattctccttctccccaacag

SEQ ID NO: 1138 - DNA, 187 bp, Homo sapiens
gtaagtgtctccaaacctctttcctaattctgggtttgggtttgggggtagggttagtaccggtatggaagcagtgggggaaatttaaagttttggtcttgggggaggatggatggaggtgaaagtaggggggtattttctaggaagtttaagggtctcagctttttcttttctctctcctcttcag

SEQ ID NO: 1139 - DNA, 301 bp, Homo sapiens
gtaagagctctgaggatgtgtcttggaacttggagggctaggatttggggattgaagcccggctgatggtaggcagaacttggagacaatgtgagaaggactcgctgagctcaagggaagggtggaggaacagcacaggccttagtgggatactcagaacgtcatggccaggtgggatgtgggatgacagacagagaggacaggaaccggatgtggggtgggcagagctcgagggccaggatgtggagagtgaaccgacatggccacactgactctcctctccctctctccctccctccag

SEQ ID NO: 1140 - DNA, 478 bp, Homo sapiens
caaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattac

SEQ ID NO: 1141 - DNA, 743 bp, Homo sapiens
cccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaa

SEQ ID NO: 1142 - DNA, 46 bp, Homo sapiens
ttccccagggacctctctctaatcagccctctggcccaggcagtca

SEQ ID NO: 1143 - DNA, 48 bp, Homo sapiens
gatcatcttctcgaaccccgagtgacaagcctgtagcccatgttgtag

SEQ ID NO: 1144 - protein, 143 aa, Homo sapiens [sequence omitted]

SEQ ID NO: 1145 - protein, 73 aa, Homo sapiens
MSTESMIRDVELAEEALPKKTGGPQGSRRCLFLSLFSFLIVAGATTLFCLLHFGVIGPQREEQTLKLRGSSSG

SEQ ID NO: 1146 - protein, 217 aa, Homo sapiens [sequence omitted]

SEQ ID NO: 1147 - protein, 233 aa, Homo sapiens
MSTESMIRDVELAEEALPKKTGGPQGSRRCLFLSLFSFLIVAGATTLFCLLHFGVIGPQREEFPRDLSLISPLAQAVRSSSRTPSDKPVAHVVTNPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 1148 - protein, 379 aa, Homo sapiens
MVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHHHSESPTST

SEQ ID NO: 1149 - DNA, 1806 bp, Homo sapiens
gcgcgacgtcggccgtgcggggtcccggcgtcggcggcgcgcgcgctaccgcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagt

SEQ ID NO: 1150 - protein, 508 aa, Homo sapiens
QPPLGAGSWRPCTDPRPSVPSPRALRGCPDREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHHHSESPKAPVPLLPPLPPPPPEPESSEDPTSPPEPQDLSSSVCKEEKMPRGGSLESDGCPKEPAKTQPAVATAATAAEKYKHRGEGERKDIVSSSMPRPNREEPVDSRTPVTERVS

SEQ ID NO: 1151 - DNA, 1659 bp, Homo sapiens
cccagcctcctctgggagcgggcagttggcgaccctgcactgacccgcgtccctccgtcccgagcccgcgcgccctcagagggtgcccggacagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagt

SEQ ID NO: 1152 - protein, 247 aa, Homo sapiens
MVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTPTST

SEQ ID NO: 1153 - DNA, 1410 bp, Homo sapiens
gcgcgacgtcggccgtgcggggtcccggcgtcggcggcgcgcgcgctaccgcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagt

SEQ ID NO: 1154 - protein, 486 aa, Homo sapiens
MVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHHHSESPKAPVPLLPPLPPPPPEPESSEDPTSPPEPQDLSSSVCKEEKMPRGGSLESDGCPKEPAKTQPAVATAATAAEKYKHRGEGERKDIVSSSMPRPNREEPVDSRTPVTERVS

SEQ ID NO: 1155 - protein, 233 aa, Homo sapiens
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

What is claimed is:

1. An antibody or binding fragment thereof which specifically binds to the tail portion of the Vascular endothelial growth factor (VEGF) receptor HSFLT PEA-1 P10 of SEQ ID NO:533, wherein the tail portion consisting of the amino acid sequence ELYTSTSPSSSSSSPLSSSSSSSSSSSS corresponding to amino acids 706-733 of SEQ ID NO:533.

2. A kit comprising the antibody of claim 1 and at least one reagent for performing an immunoassay.

3. The kit of claim 2, wherein said immunoassay is selected from the group consisting of an enzyme linked immunosorbent assay (ELISA), an immunoprecipitation assay, an immunofluorescence analysis, FACS analysis, an enzyme immunoassay (EIA), a radioimmunoassay (RIA), and a Western blot analysis.

4. A method of detecting the binding of the antibody of claim 1 to an epitope of a polypeptide comprising the amino acid sequence ELYTSTSPSSSSSSPLSSSSSSSSSSSS, wherein the epitope corresponds to amino acids 706-733 of SEQ ID NO:533, the method comprising the steps of contacting the antibody to a sample from a patient and detecting the binding of said antibody to said polypeptide.

5. The method of claim 4, wherein the patient is suspected of having a disease selected from the group consisting of peripheral vascular disease, ulcers, diabetes, ischemia, and cancer.

* * * * *